United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 19

SEQ ID NO: 298842 - DNA, 20 bp, Artificial Sequence
  Description of Artificial Sequence: Synthetic oligonucleotide
  Target: ATXN1; (+) strand; PAM type: YTN; PAM sequence: TTG
agttcataatgtggtaatat

SEQ ID NO: 298843 - DNA, 20 bp, Artificial Sequence
  Description of Artificial Sequence: Synthetic oligonucleotide
  Target: ATXN1; (+) strand; PAM type: YTN; PAM sequence: TTC
ataatgtggtaatattaaga

SEQ ID NO: 298844 - DNA, 20 bp, Artificial Sequence
  Description of Artificial Sequence: Synthetic oligonucleotide
  Target: ATXN1; (+) strand; PAM type: YTN; PAM sequence: TTA
agagtaatttttaaaataat

SEQ ID NO: 298845 - DNA, 20 bp, Artificial Sequence
  Description of Artificial Sequence: Synthetic oligonucleotide
  Target: ATXN1; (+) strand; PAM type: YTN; PAM sequence: TTT
ttaaaataatttcttttaaa

SEQ ID NO: 298846 - DNA, 20 bp, Artificial Sequence
  Description of Artificial Sequence: Synthetic oligonucleotide
  Target: ATXN1; (+) strand; PAM type: YTN; PAM sequence: TTT
taaaataatttcttttaaag

SEQ ID NO: 298847 - DNA, 20 bp, Artificial Sequence
  Description of Artificial Sequence: Synthetic oligonucleotide
  Target: ATXN1; (+) strand; PAM type: YTN; PAM sequence: TTT
aaaataatttcttttaaaga

SEQ ID NO: 298848 - DNA, 20 bp, Artificial Sequence
  Description of Artificial Sequence: Synthetic oligonucleotide
  Target: ATXN1; (+) strand; PAM type: YTN; PAM sequence: TTA
aaataatttcttttaaagat

SEQ ID NO: 298849 - DNA, 20 bp, Artificial Sequence
  Description of Artificial Sequence: Synthetic oligonucleotide
  Target: ATXN1; (+) strand; PAM type: YTN; PAM sequence: TTT
cttttaaagataaatattta

SEQ ID NO: 298850 - DNA, 20 bp, Artificial Sequence
  Description of Artificial Sequence: Synthetic oligonucleotide
  Target: ATXN1; (+) strand; PAM type: YTN; PAM sequence: TTC
ttttaaagataaatatttaa

SEQ ID NO: 298851 - DNA, 20 bp, Artificial Sequence
  Description of Artificial Sequence: Synthetic oligonucleotide
  Target: ATXN1; (+) strand; PAM type: YTN; PAM sequence: CTT
ttaaagataaatatttaatg

SEQ ID NO: 298852 - DNA, 20 bp, Artificial Sequence
  Description of Artificial Sequence: Synthetic oligonucleotide
  Target: ATXN1; (+) strand; PAM type: YTN; PAM sequence: TTT
taaagataaatatttaatgt

SEQ ID NO: 298853 - DNA, 20 bp, Artificial Sequence
  Description of Artificial Sequence: Synthetic oligonucleotide
  Target: ATXN1; (+) strand; PAM type: YTN; PAM sequence: TTT
aaagataaatatttaatgtg

SEQ ID NO: 298854 - DNA, 20 bp, Artificial Sequence
  Description of Artificial Sequence: Synthetic oligonucleotide
  Target: ATXN1; (+) strand; PAM type: YTN; PAM sequence: TTA
aagataaatatttaatgtga

SEQ ID NO: 298855 - DNA, 20 bp, Artificial Sequence
  Description of Artificial Sequence: Synthetic oligonucleotide
  Target: ATXN1; (+) strand; PAM type: YTN; PAM sequence: TTT
aatgtgattgctatattatc

SEQ ID NO: 298856 - DNA, 20 bp, Artificial Sequence
  Description of Artificial Sequence: Synthetic oligonucleotide
  Target: ATXN1; (+) strand; PAM type: YTN; PAM sequence: TTA
atgtgattgctatattatct

SEQ ID NO: 298857 - DNA, 20 bp, Artificial Sequence
  Description of Artificial Sequence: Synthetic oligonucleotide
  Target: ATXN1; (+) strand; PAM type: YTN; PAM sequence: TTG
ctatattatctgccttttca

SEQ ID NO: 298858 - DNA, 20 bp, Artificial Sequence
  Description of Artificial Sequence: Synthetic oligonucleotide
  Target: ATXN1; (+) strand; PAM type: YTN; PAM sequence: CTA
tattatctgccttttcaaaa

SEQ ID NO: 298859 - DNA, 20 bp, Artificial Sequence
  Description of Artificial Sequence: Synthetic oligonucleotide
  Target: ATXN1; (+) strand; PAM type: YTN; PAM sequence: TTA
tctgccttttcaaaaagtta

SEQ ID NO: 298860 - DNA, 20 bp, Artificial Sequence
  Description of Artificial Sequence: Synthetic oligonucleotide
  Target: ATXN1; (+) strand; PAM type: YTN; PAM sequence: CTG
ccttttcaaaaagttaaagc

SEQ ID NO: 298861 - DNA, 20 bp, Artificial Sequence
  Description of Artificial Sequence: Synthetic oligonucleotide
  Target: ATXN1; (+) strand; PAM type: YTN; PAM sequence: CTT
ttcaaaaagttaaagcacat

SEQ ID NO: 298862 - DNA, 20 bp, Artificial Sequence
  Description of Artificial Sequence: Synthetic oligonucleotide
  Target: ATXN1; (+) strand; PAM type: YTN; PAM sequence: TTT
tcaaaaagttaaagcacata

SEQ ID NO: 298863 - DNA, 20 bp, Artificial Sequence
  Description of Artificial Sequence: Synthetic oligonucleotide
  Target: ATXN1; (+) strand; PAM type: YTN; PAM sequence: TTT
caaaaagttaaagcacatag

SEQ ID NO: 298864 - DNA, 20 bp, Artificial Sequence
  Description of Artificial Sequence: Synthetic oligonucleotide
  Target: ATXN1; (+) strand; PAM type: YTN; PAM sequence: TTC
aaaaagttaaagcacatagt

SEQ ID NO: 298865 - DNA, 20 bp, Artificial Sequence
  Description of Artificial Sequence: Synthetic oligonucleotide
  Target: ATXN1; (+) strand; PAM type: YTN; PAM sequence: TTA
aagcacatagtcaagtaagt

SEQ ID NO: 298866 - DNA, 20 bp, Artificial Sequence
  Description of Artificial Sequence: Synthetic oligonucleotide
  Target: ATXN1; (+) strand; PAM type: YTN; PAM sequence: TTT
gccaaggcccaatacacctt

SEQ ID NO: 298867 - DNA, 20 bp, Artificial Sequence
  Description of Artificial Sequence: Synthetic oligonucleotide
  Target: ATXN1; (+) strand; PAM type: YTN; PAM sequence: TTG
ccaaggcccaatacaccttt

SEQ ID NO: 298868 - DNA, 20 bp, Artificial Sequence
  Description of Artificial Sequence: Synthetic oligonucleotide
  Target: ATXN1; (+) strand; PAM type: YTN; PAM sequence: CTT
tatttttctttcctagtttt

SEQ ID NO: 298869 - DNA, 20 bp, Artificial Sequence
  Description of Artificial Sequence: Synthetic oligonucleotide
  Target: ATXN1; (+) strand; PAM type: YTN; PAM sequence: TTT
atttttctttcctagttttt

SEQ ID NO: 298870 - DNA, 20 bp, Artificial Sequence
  Description of Artificial Sequence: Synthetic oligonucleotide
  Target: ATXN1; (+) strand; PAM type: YTN; PAM sequence: TTA
tttttctttcctagtttttc

SEQ ID NO: 298871 - DNA, 20 bp, Artificial Sequence
  Description of Artificial Sequence: Synthetic oligonucleotide
  Target: ATXN1; (+) strand; PAM type: YTN; PAM sequence: TTT
ttctttcctagtttttcact

SEQ ID NO: 298872 - DNA, 20 bp, Artificial Sequence
  Description of Artificial Sequence: Synthetic oligonucleotide
  Target: ATXN1; (+) strand; PAM type: YTN; PAM sequence: TTT
tctttcctagtttttcactg

SEQ ID NO: 298873 - DNA, 20 bp, Artificial Sequence
  Description of Artificial Sequence: Synthetic oligonucleotide
  Target: ATXN1; (+) strand; PAM type: YTN; PAM sequence: TTT
ctttcctagtttttcactgt

SEQ ID NO: 298874 - DNA, 20 bp, Artificial Sequence
  Description of Artificial Sequence: Synthetic oligonucleotide
  Target: ATXN1; (+) strand; PAM type: YTN; PAM sequence: TTC
tttcctagtttttcactgtc

SEQ ID NO: 298875 - DNA, 20 bp, Artificial Sequence
  Description of Artificial Sequence: Synthetic oligonucleotide
  Target: ATXN1; (+) strand; PAM type: YTN; PAM sequence: CTT
tcctagtttttcactgtctt

SEQ ID NO: 298876 - DNA, 20 bp, Artificial Sequence
  Description of Artificial Sequence: Synthetic oligonucleotide
  Target: ATXN1; (+) strand; PAM type: YTN; PAM sequence: TTT
cctagtttttcactgtcttg

SEQ ID NO: 298877 - DNA, 20 bp, Artificial Sequence
  Description of Artificial Sequence: Synthetic oligonucleotide
  Target: ATXN1; (+) strand; PAM type: YTN; PAM sequence: TTC
ctagtttttcactgtcttga

SEQ ID NO: 298878 - DNA, 20 bp, Artificial Sequence
  Description of Artificial Sequence: Synthetic oligonucleotide
  Target: ATXN1; (+) strand; PAM type: YTN; PAM sequence: CTA
gtttttcactgtcttgaagt

SEQ ID NO: 298879 - DNA, 20 bp, Artificial Sequence
  Description of Artificial Sequence: Synthetic oligonucleotide
  Target: ATXN1; (+) strand; PAM type: YTN; PAM sequence: TTT
ttcactgtcttgaagtcttt

SEQ ID NO: 298880 - DNA, 20 bp, Artificial Sequence
  Description of Artificial Sequence: Synthetic oligonucleotide
  Target: ATXN1; (+) strand; PAM type: YTN; PAM sequence: TTT
tcactgtcttgaagtctttt

SEQ ID NO: 298881 - DNA, 20 bp, Artificial Sequence
  Description of Artificial Sequence: Synthetic oligonucleotide
  Target: ATXN1; (+) strand; PAM type: YTN; PAM sequence: TTT
cactgtcttgaagtctttta

SEQ ID NO: 298882 - DNA, 20 bp, Artificial Sequence
  Description of Artificial Sequence: Synthetic oligonucleotide
  Target: ATXN1; (+) strand; PAM type: YTN; PAM sequence: TTC
actgtcttgaagtcttttac

SEQ ID NO: 298883 - DNA, 20 bp, Artificial Sequence
  Description of Artificial Sequence: Synthetic oligonucleotide
  Target: ATXN1; (+) strand; PAM type: YTN; PAM sequence: CTG
tcttgaagtcttttacccac

SEQ ID NO: 298884 - DNA, 20 bp, Artificial Sequence
  Description of Artificial Sequence: Synthetic oligonucleotide
  Target: ATXN1; (+) strand; PAM type: YTN; PAM sequence: CTT
gaagtcttttacccacagtc

SEQ ID NO: 298885 - DNA, 20 bp, Artificial Sequence
  Description of Artificial Sequence: Synthetic oligonucleotide
  Target: ATXN1; (+) strand; PAM type: YTN; PAM sequence: TTG
aagtcttttacccacagtct

SEQ ID NO: 298886 - DNA, 20 bp, Artificial Sequence
  Description of Artificial Sequence: Synthetic oligonucleotide
  Target: ATXN1; (+) strand; PAM type: YTN; PAM sequence: CTT
ttacccacagtctcccatat

SEQ ID NO: 298887 - DNA, 20 bp, Artificial Sequence
  Description of Artificial Sequence: Synthetic oligonucleotide
  Target: ATXN1; (+) strand; PAM type: YTN; PAM sequence: TTT
tacccacagtctcccatatt

SEQ ID NO: 298888 - DNA, 20 bp, Artificial Sequence
  Description of Artificial Sequence: Synthetic oligonucleotide
  Target: ATXN1; (+) strand; PAM type: YTN; PAM sequence: TTT
acccacagtctcccatattc

SEQ ID NO: 298889 - DNA, 20 bp, Artificial Sequence
  Description of Artificial Sequence: Synthetic oligonucleotide
  Target: ATXN1; (+) strand; PAM type: YTN; PAM sequence: TTA
cccacagtctcccatattca

SEQ ID NO: 298890 - DNA, 20 bp, Artificial Sequence
  Description of Artificial Sequence: Synthetic oligonucleotide
  Target: ATXN1; (+) strand; PAM type: YTN; PAM sequence: CTC
ccatattcaatacagataat

SEQ ID NO: 298891 - DNA, 20 bp, Artificial Sequence
  Description of Artificial Sequence: Synthetic oligonucleotide
  Target: ATXN1; (+) strand; PAM type: YTN; PAM sequence: TTC
aatacagataataaattcta

SEQ ID NO: 298892 - DNA, 20 bp, Artificial Sequence
  Description of Artificial Sequence: Synthetic oligonucleotide
  Target: ATXN1; (+) strand; PAM type: YTN; PAM sequence: TTC
tatcagaatgtgtaaagttc

SEQ ID NO: 298893 - DNA, 20 bp, Artificial Sequence
  Description of Artificial Sequence: Synthetic oligonucleotide
  Target: ATXN1; (+) strand; PAM type: YTN; PAM sequence: CTA
tcagaatgtgtaaagttcaa

SEQ ID NO: 298894 - DNA, 20 bp, Artificial Sequence
  Description of Artificial Sequence: Synthetic oligonucleotide
  Target: ATXN1; (+) strand; PAM type: YTN; PAM sequence: TTC
aaataggtatcagaggctgc

SEQ ID NO: 298895 - DNA, 20 bp, Artificial Sequence
  Description of Artificial Sequence: Synthetic oligonucleotide
  Target: ATXN1; (+) strand; PAM type: YTN; PAM sequence: CTG
ctgccctgcctctttgctct

SEQ ID NO: 298896 - DNA, 20 bp, Artificial Sequence
  Description of Artificial Sequence: Synthetic oligonucleotide
  Target: ATXN1; (+) strand; PAM type: YTN; PAM sequence: CTG
ccctgcctctttgctctgta

SEQ ID NO: 298897 - DNA, 20 bp, Artificial Sequence
  Description of Artificial Sequence: Synthetic oligonucleotide
  Target: ATXN1; (+) strand; PAM type: YTN; PAM sequence: CTG
cctctttgctctgtactctt

SEQ ID NO: 298898 - DNA, 20 bp, Artificial Sequence
  Description of Artificial Sequence: Synthetic oligonucleotide
  Target: ATXN1; (+) strand; PAM type: YTN; PAM sequence: CTC
tttgctctgtactcttgttt

SEQ ID NO: 298899 - DNA, 20 bp, Artificial Sequence
  Description of Artificial Sequence: Synthetic oligonucleotide
  Target: ATXN1; (+) strand; PAM type: YTN; PAM sequence: CTT
tgctctgtactcttgttttt

SEQ ID NO: 298900 - DNA, 20 bp, Artificial Sequence
  Description of Artificial Sequence: Synthetic oligonucleotide
  Target: ATXN1; (+) strand; PAM type: YTN; PAM sequence: TTT
gctctgtactcttgtttttt

SEQ ID NO: 298901 - DNA, 20 bp, Artificial Sequence
  Description of Artificial Sequence: Synthetic oligonucleotide
  Target: ATXN1; (+) strand; PAM type: YTN; PAM sequence: TTG
ctctgtactcttgttttttt

SEQ ID NO: 298902 - DNA, 20 bp, Artificial Sequence
  Description of Artificial Sequence: Synthetic oligonucleotide
  Target: ATXN1; (+) strand; PAM type: YTN; PAM sequence: CTC
tgtactcttgtttttttctg

SEQ ID NO: 298903 - DNA, 20 bp, Artificial Sequence
  Description of Artificial Sequence: Synthetic oligonucleotide
  Target: ATXN1; (+) strand; PAM type: YTN; PAM sequence: CTG
tactcttgtttttttctggt

SEQ ID NO: 298904 - DNA, 20 bp, Artificial Sequence
  Description of Artificial Sequence: Synthetic oligonucleotide
  Target: ATXN1; (+) strand; PAM type: YTN; PAM sequence: CTC
ttgtttttttctggtgggag

SEQ ID NO: 298905 - DNA, 20 bp, Artificial Sequence
  Description of Artificial Sequence: Synthetic oligonucleotide
  Target: ATXN1; (+) strand; PAM type: YTN; PAM sequence: CTT
gtttttttctggtgggagca

SEQ ID NO: 298906 - DNA, 20 bp, Artificial Sequence
  Description of Artificial Sequence: Synthetic oligonucleotide
  Target: ATXN1; (+) strand; PAM type: YTN; PAM sequence: TTG
tttttttctggtgggagcag

SEQ ID NO: 298907 - DNA, 20 bp, Artificial Sequence
  Description of Artificial Sequence: Synthetic oligonucleotide
  Target: ATXN1; (+) strand; PAM type: YTN; PAM sequence: TTT
ttttctggtgggagcagaat

SEQ ID NO: 298908 - DNA, 20 bp, Artificial Sequence
  Description of Artificial Sequence: Synthetic oligonucleotide
  Target: ATXN1; (+) strand; PAM type: YTN; PAM sequence: TTT
tttctggtgggagcagaatt

SEQ ID NO: 298909 - DNA, 20 bp, Artificial Sequence
  Description of Artificial Sequence: Synthetic oligonucleotide
  Target: ATXN1; (+) strand; PAM type: YTN; PAM sequence: TTT
ttctggtgggagcagaattg

SEQ ID NO: 298910 - DNA, 20 bp, Artificial Sequence
  Description of Artificial Sequence: Synthetic oligonucleotide
  Target: ATXN1; (+) strand; PAM type: YTN; PAM sequence: TTT
tctggtgggagcagaattgg

SEQ ID NO: 298911 - DNA, 20 bp, Artificial Sequence
  Description of Artificial Sequence: Synthetic oligonucleotide
  Target: ATXN1; (+) strand; PAM type: YTN; PAM sequence: TTT
ctggtgggagcagaattggc

SEQ ID NO: 298912 - DNA, 20 bp, Artificial Sequence
  Description of Artificial Sequence: Synthetic oligonucleotide
  Target: ATXN1; (+) strand; PAM type: YTN; PAM sequence: TTC
tggtgggagcagaattggcc

SEQ ID NO: 298913 - DNA, 20 bp, Artificial Sequence
  Description of Artificial Sequence: Synthetic oligonucleotide
  Target: ATXN1; (+) strand; PAM type: YTN; PAM sequence: CTG
gtgggagcagaattggcctg

SEQ ID NO: 298914 - DNA, 20 bp, Artificial Sequence
  Description of Artificial Sequence: Synthetic oligonucleotide
  Target: ATXN1; (+) strand; PAM type: YTN; PAM sequence: TTG
gcctgtgtagagggtcaggg

SEQ ID NO: 298915 - DNA, 20 bp, Artificial Sequence
  Description of Artificial Sequence: Synthetic oligonucleotide
  Target: ATXN1; (+) strand; PAM type: YTN; PAM sequence: CTG
tgtagagggtcaggggtaga

SEQ ID NO: 298916 - DNA, 20 bp, Artificial Sequence
  Description of Artificial Sequence: Synthetic oligonucleotide
  Target: ATXN1; (+) strand; PAM type: YTN; PAM sequence: CTT
tgggacactgtaactaatta

SEQ ID NO: 298917 - DNA, 20 bp, Artificial Sequence
  Description of Artificial Sequence: Synthetic oligonucleotide
  Target: ATXN1; (+) strand; PAM type: YTN; PAM sequence: TTT
gggacactgtaactaattat

SEQ ID NO: 298918 - DNA, 20 bp, Artificial Sequence
  Description of Artificial Sequence: Synthetic oligonucleotide
  Target: ATXN1; (+) strand; PAM type: YTN; PAM sequence: TTG
ggacactgtaactaattatc

SEQ ID NO: 298919 - DNA, 20 bp, Artificial Sequence
  Description of Artificial Sequence: Synthetic oligonucleotide
  Target: ATXN1; (+) strand; PAM type: YTN; PAM sequence: CTG
taactaattatcacaacatt

SEQ ID NO: 298920 - DNA, 20 bp, Artificial Sequence
  Description of Artificial Sequence: Synthetic oligonucleotide
  Target: ATXN1; (+) strand; PAM type: YTN; PAM sequence: CTA
attatcacaacatttgcttt

SEQ ID NO: 298921 - DNA, 20 bp, Artificial Sequence
  Description of Artificial Sequence: Synthetic oligonucleotide
  Target: ATXN1; (+) strand; PAM type: YTN; PAM sequence: TTA
tcacaacatttgctttcaga

SEQ ID NO: 298922 - DNA, 20 bp, Artificial Sequence
  Description of Artificial Sequence: Synthetic oligonucleotide
  Target: ATXN1; (+) strand; PAM type: YTN; PAM sequence: TTT
gctttcagaagccccagaaa

SEQ ID NO: 298923 - DNA, 20 bp, Artificial Sequence
  Description of Artificial Sequence: Synthetic oligonucleotide
  Target: ATXN1; (+) strand; PAM type: YTN; PAM sequence: TTG
ctttcagaagccccagaaag

SEQ ID NO: 298924 - DNA, 20 bp, Artificial Sequence
  Description of Artificial Sequence: Synthetic oligonucleotide
  Target: ATXN1; (+) strand; PAM type: YTN; PAM sequence: CTT
tcagaagccccagaaaggcc

SEQ ID NO: 298925 - DNA, 20 bp, Artificial Sequence
  Description of Artificial Sequence: Synthetic oligonucleotide
  Target: ATXN1; (+) strand; PAM type: YTN; PAM sequence: TTT
cagaagccccagaaaggccc

SEQ ID NO: 298926 - DNA, 20 bp, Artificial Sequence
  Description of Artificial Sequence: Synthetic oligonucleotide
  Target: ATXN1; (+) strand; PAM type: YTN; PAM sequence: TTC
agaagccccagaaaggcccc

SEQ ID NO: 298927 - DNA, 20 bp, Artificial Sequence
  Description of Artificial Sequence: Synthetic oligonucleotide
  Target: ATXN1; (+) strand; PAM type: YTN; PAM sequence: CTA
ccccccaaacatgtccttct

SEQ ID NO: 298928 - DNA, 20 bp, Artificial Sequence
  Description of Artificial Sequence: Synthetic oligonucleotide
  Target: ATXN1; (+) strand; PAM type: YTN; PAM sequence: CTT
ctgttccttccttttctttc

SEQ ID NO: 298929 - DNA, 20 bp, Artificial Sequence
  Description of Artificial Sequence: Synthetic oligonucleotide
  Target: ATXN1; (+) strand; PAM type: YTN; PAM sequence: TTC
tgttccttccttttctttct

SEQ ID NO: 298930 - DNA, 20 bp, Artificial Sequence
  Description of Artificial Sequence: Synthetic oligonucleotide
  Target: ATXN1; (+) strand; PAM type: YTN; PAM sequence: CTG
ttccttccttttctttcttt

SEQ ID NO: 298931 - DNA, 20 bp, Artificial Sequence
  Description of Artificial Sequence: Synthetic oligonucleotide
  Target: ATXN1; (+) strand; PAM type: YTN; PAM sequence: TTC
cttccttttctttcttttcc

SEQ ID NO: 298932 - DNA, 20 bp, Artificial Sequence
  Description of Artificial Sequence: Synthetic oligonucleotide
  Target: ATXN1; (+) strand; PAM type: YTN; PAM sequence: CTT
ccttttctttcttttccttc

SEQ ID NO: 298933 - DNA, 20 bp, Artificial Sequence
  Description of Artificial Sequence: Synthetic oligonucleotide
  Target: ATXN1; (+) strand; PAM type: YTN; PAM sequence: TTC
cttttctttcttttccttct

SEQ ID NO: 298934 - DNA, 20 bp, Artificial Sequence
  Description of Artificial Sequence: Synthetic oligonucleotide
  Target: ATXN1; (+) strand; PAM type: YTN; PAM sequence: CTT
ttctttcttttccttctcta

SEQ ID NO: 298935 - DNA, 20 bp, Artificial Sequence
  Description of Artificial Sequence: Synthetic oligonucleotide
  Target: ATXN1; (+) strand; PAM type: YTN; PAM sequence: TTT
tctttcttttccttctctaa

SEQ ID NO: 298936 - DNA, 20 bp, Artificial Sequence
  Description of Artificial Sequence: Synthetic oligonucleotide
  Target: ATXN1; (+) strand; PAM type: YTN; PAM sequence: TTT
ctttcttttccttctctaat

SEQ ID NO: 298937 - DNA, 20 bp, Artificial Sequence
  Description of Artificial Sequence: Synthetic oligonucleotide
  Target: ATXN1; (+) strand; PAM type: YTN; PAM sequence: TTC
tttcttttccttctctaatc

SEQ ID NO: 298938 - DNA, 20 bp, Artificial Sequence
  Description of Artificial Sequence: Synthetic oligonucleotide
  Target: ATXN1; (+) strand; PAM type: YTN; PAM sequence: CTT
tcttttccttctctaatcta

SEQ ID NO: 298939 - DNA, 20 bp, Artificial Sequence
  Description of Artificial Sequence: Synthetic oligonucleotide
  Target: ATXN1; (+) strand; PAM type: YTN; PAM sequence: TTT
cttttccttctctaatctac

SEQ ID NO: 298940 - DNA, 20 bp, Artificial Sequence
  Description of Artificial Sequence: Synthetic oligonucleotide
  Target: ATXN1; (+) strand; PAM type: YTN; PAM sequence: TTC
ttttccttctctaatctaca

SEQ ID NO: 298941 - DNA, 20 bp, Artificial Sequence
  Description of Artificial Sequence: Synthetic oligonucleotide
  Target: ATXN1; (+) strand; PAM type: YTN; PAM sequence: CTT
ttccttctctaatctacagt

SEQ ID NO: 298942 - DNA, 20 bp, Artificial Sequence
  Description of Artificial Sequence: Synthetic oligonucleotide
  Target: ATXN1; (+) strand; PAM type: YTN; PAM sequence: TTT
tccttctctaatctacagtg

SEQ ID NO: 298943 - DNA, 20 bp, Artificial Sequence
  Description of Artificial Sequence: Synthetic oligonucleotide
  Target: ATXN1; (+) strand; PAM type: YTN; PAM sequence: TTT
ccttctctaatctacagtgt

SEQ ID NO: 298944 - DNA, 20 bp, Artificial Sequence
  Description of Artificial Sequence: Synthetic oligonucleotide
  Target: ATXN1; (+) strand; PAM type: YTN; PAM sequence: TTC
cttctctaatctacagtgtg

SEQ ID NO: 298945 - DNA, 20 bp, Artificial Sequence
  Description of Artificial Sequence: Synthetic oligonucleotide
  Target: ATXN1; (+) strand; PAM type: YTN; PAM sequence: CTT
ctctaatctacagtgtgctg

SEQ ID NO: 298946 - DNA, 20 bp, Artificial Sequence
  Description of Artificial Sequence: Synthetic oligonucleotide
  Target: ATXN1; (+) strand; PAM type: YTN; PAM sequence: TTC
tctaatctacagtgtgctga

SEQ ID NO: 298947 - DNA, 20 bp, Artificial Sequence
  Description of Artificial Sequence: Synthetic oligonucleotide
  Target: ATXN1; (+) strand; PAM type: YTN; PAM sequence: CTC
taatctacagtgtgctgagt

SEQ ID NO: 298948 - DNA, 20 bp, Artificial Sequence
  Description of Artificial Sequence: Synthetic oligonucleotide
  Target: ATXN1; (+) strand; PAM type: YTN; PAM sequence: CTA
atctacagtgtgctgagttc

SEQ ID NO: 298949 - DNA, 20 bp, Artificial Sequence
  Description of Artificial Sequence: Synthetic oligonucleotide
  Target: ATXN1; (+) strand; PAM type: YTN; PAM sequence: CTA
cagtgtgctgagttccaaag

SEQ ID NO: 298950 - DNA, 20 bp, Artificial Sequence
  Description of Artificial Sequence: Synthetic oligonucleotide
  Target: ATXN1; (+) strand; PAM type: YTN; PAM sequence: CTG
agttccaaagcaaattctca

SEQ ID NO: 298951 - DNA, 20 bp, Artificial Sequence
  Description of Artificial Sequence: Synthetic oligonucleotide
  Target: ATXN1; (+) strand; PAM type: YTN; PAM sequence: TTC
caaagcaaattctcatccat

SEQ ID NO: 298952 - DNA, 20 bp, Artificial Sequence
  Description of Artificial Sequence: Synthetic oligonucleotide
  Target: ATXN1; (+) strand; PAM type: YTN; PAM sequence: TTC
tcatccattatacttttcag

SEQ ID NO: 298953 - DNA, 20 bp, Artificial Sequence
  Description of Artificial Sequence: Synthetic oligonucleotide
  Target: ATXN1; (+) strand; PAM type: YTN; PAM sequence: CTC
atccattatacttttcagct

SEQ ID NO: 298954 - DNA, 20 bp, Artificial Sequence
  Description of Artificial Sequence: Synthetic oligonucleotide
  Target: ATXN1; (+) strand; PAM type: YTN; PAM sequence: TTA
tacttttcagcttctttttt

SEQ ID NO: 298955 - DNA, 20 bp, Artificial Sequence
  Description of Artificial Sequence: Synthetic oligonucleotide
  Target: ATXN1; (+) strand; PAM type: YTN; PAM sequence: CTT
ttcagcttcttttttgaaac

SEQ ID NO: 298956 - DNA, 20 bp, Artificial Sequence
  Description of Artificial Sequence: Synthetic oligonucleotide
  Target: ATXN1; (+) strand; PAM type: YTN; PAM sequence: TTT
tcagcttcttttttgaaaca

SEQ ID NO: 298957 - DNA, 20 bp, Artificial Sequence
  Description of Artificial Sequence: Synthetic oligonucleotide
  Target: ATXN1; (+) strand; PAM type: YTN; PAM sequence: TTT
cagcttcttttttgaaacat

SEQ ID NO: 298958 - DNA, 20 bp, Artificial Sequence
  Description of Artificial Sequence: Synthetic oligonucleotide
  Target: ATXN1; (+) strand; PAM type: YTN; PAM sequence: TTC
agcttcttttttgaaacata

SEQ ID NO: 298959 - DNA, 20 bp, Artificial Sequence
  Description of Artificial Sequence: Synthetic oligonucleotide
  Target: ATXN1; (+) strand; PAM type: YTN; PAM sequence: CTT
cttttttgaaacatacattc

SEQ ID NO: 298960 - DNA, 20 bp, Artificial Sequence
  Description of Artificial Sequence: Synthetic oligonucleotide
  Target: ATXN1; (+) strand; PAM type: YTN; PAM sequence: TTC
ttttttgaaacatacattcc

SEQ ID NO: 298961 - DNA, 20 bp, Artificial Sequence
  Description of Artificial Sequence: Synthetic oligonucleotide
  Target: ATXN1; (+) strand; PAM type: YTN; PAM sequence: CTT
ttttgaaacatacattcctc

SEQ ID NO: 298962 - DNA, 20 bp, Artificial Sequence
  Description of Artificial Sequence: Synthetic oligonucleotide
  Target: ATXN1; (+) strand; PAM type: YTN; PAM sequence: TTT
tttgaaacatacattcctcc

SEQ ID NO: 298963 - DNA, 20 bp, Artificial Sequence
  Description of Artificial Sequence: Synthetic oligonucleotide
  Target: ATXN1; (+) strand; PAM type: YTN; PAM sequence: TTT
ttgaaacatacattcctccg

SEQ ID NO: 298964 - DNA, 20 bp, Artificial Sequence
  Description of Artificial Sequence: Synthetic oligonucleotide
  Target: ATXN1; (+) strand; PAM type: YTN; PAM sequence: TTT
tgaaacatacattcctccgg

SEQ ID NO: 298965 - DNA, 20 bp, Artificial Sequence
  Description of Artificial Sequence: Synthetic oligonucleotide
  Target: ATXN1; (+) strand; PAM type: YTN; PAM sequence: TTT
gaaacatacattcctccggg

SEQ ID NO: 298966 - DNA, 20 bp, Artificial Sequence
  Description of Artificial Sequence: Synthetic oligonucleotide
  Target: ATXN1; (+) strand; PAM type: YTN; PAM sequence: TTG
aaacatacattcctccggga

SEQ ID NO: 298967 - DNA, 20 bp, Artificial Sequence
  Description of Artificial Sequence: Synthetic oligonucleotide
  Target: ATXN1; (+) strand; PAM type: YTN; PAM sequence: TTC
ctccgggaggattaacaaac

SEQ ID NO: 298968 - DNA, 20 bp, Artificial Sequence
  Description of Artificial Sequence: Synthetic oligonucleotide
  Target: ATXN1; (+) strand; PAM type: YTN; PAM sequence: CTC
cgggaggattaacaaactga

SEQ ID NO: 298969 - DNA, 20 bp, Artificial Sequence
  Description of Artificial Sequence: Synthetic oligonucleotide
  Target: ATXN1; (+) strand; PAM type: YTN; PAM sequence: TTA
acaaactgagatactaacaa

SEQ ID NO: 298970 - DNA, 20 bp, Artificial Sequence
  Description of Artificial Sequence: Synthetic oligonucleotide
  Target: ATXN1; (+) strand; PAM type: YTN; PAM sequence: CTG
agatactaacaagctgtgtg

SEQ ID NO: 298971 - DNA, 20 bp, Artificial Sequence
  Description of Artificial Sequence: Synthetic oligonucleotide
  Target: ATXN1; (+) strand; PAM type: YTN; PAM sequence: CTA
acaagctgtgtggttcattc

SEQ ID NO: 298972 - DNA, 20 bp, Artificial Sequence
  Description of Artificial Sequence: Synthetic oligonucleotide
  Target: ATXN1; (+) strand; PAM type: YTN; PAM sequence: CTG
tgtggttcattcatcagacc

SEQ ID NO: 298973 - DNA, 20 bp, Artificial Sequence
  Description of Artificial Sequence: Synthetic oligonucleotide
  Target: ATXN1; (+) strand; PAM type: YTN; PAM sequence: TTC
attcatcagacccttcaagg

SEQ ID NO: 298974 - DNA, 20 bp, Artificial Sequence
  Description of Artificial Sequence: Synthetic oligonucleotide
  Target: ATXN1; (+) strand; PAM type: YTN; PAM sequence: TTC
atcagacccttcaagggaag

SEQ ID NO: 298975 - DNA, 20 bp, Artificial Sequence
  Description of Artificial Sequence: Synthetic oligonucleotide
  Target: ATXN1; (+) strand; PAM type: YTN; PAM sequence: CTT
caagggaagaaggacccagg

SEQ ID NO: 298976 - DNA, 20 bp, Artificial Sequence
  Description of Artificial Sequence: Synthetic oligonucleotide
  Target: ATXN1; (+) strand; PAM type: YTN; PAM sequence: TTC
aagggaagaaggacccaggg

SEQ ID NO: 298977 - DNA, 20 bp, Artificial Sequence
  Description of Artificial Sequence: Synthetic oligonucleotide
  Target: ATXN1; (+) strand; PAM type: YTN; PAM sequence: CTC
tgacactggggcaggggtga

SEQ ID NO: 298978 - DNA, 20 bp, Artificial Sequence
  Description of Artificial Sequence: Synthetic oligonucleotide
  Target: ATXN1; (+) strand; PAM type: YTN; PAM sequence: CTG
acactggggcaggggtgagg

SEQ ID NO: 298979 - DNA, 20 bp, Artificial Sequence
  Description of Artificial Sequence: Synthetic oligonucleotide
  Target: ATXN1; (+) strand; PAM type: YTN; PAM sequence: CTG
gggcaggggtgaggcatcac

SEQ ID NO: 298980 - DNA, 20 bp, Artificial Sequence
  Description of Artificial Sequence: Synthetic oligonucleotide
  Target: ATXN1; (+) strand; PAM type: YTN; PAM sequence: TTC
cagaaaacaagggaaaccag

SEQ ID NO: 298981 - DNA, 20 bp, Artificial Sequence
  Description of Artificial Sequence: Synthetic oligonucleotide
  Target: ATXN1; (+) strand; PAM type: YTN; PAM sequence: TTA
ctgtcctatgctccaactgc

SEQ ID NO: 298982 - DNA, 20 bp, Artificial Sequence
  Description of Artificial Sequence: Synthetic oligonucleotide
  Target: ATXN1; (+) strand; PAM type: YTN; PAM sequence: CTG
tcctatgctccaactgccta

SEQ ID NO: 298983 - DNA, 20 bp, Artificial Sequence
  Description of Artificial Sequence: Synthetic oligonucleotide
  Target: ATXN1; (+) strand; PAM type: YTN; PAM sequence: CTA
tgctccaactgcctaaacct

SEQ ID NO: 298984 - DNA, 20 bp, Artificial Sequence
  Description of Artificial Sequence: Synthetic oligonucleotide
  Target: ATXN1; (+) strand; PAM type: YTN; PAM sequence: CTC
caactgcctaaaccttaaaa

SEQ ID NO: 298985 - DNA, 20 bp, Artificial Sequence
  Description of Artificial Sequence: Synthetic oligonucleotide
  Target: ATXN1; (+) strand; PAM type: YTN; PAM sequence: CTG
cctaaaccttaaaatgaaac

SEQ ID NO: 298986 - DNA, 20 bp, Artificial Sequence
  Description of Artificial Sequence: Synthetic oligonucleotide
  Target: ATXN1; (+) strand; PAM type: YTN; PAM sequence: CTA
aaccttaaaatgaaacaaat

SEQ ID NO: 298987 - DNA, 20 bp, Artificial Sequence
  Description of Artificial Sequence: Synthetic oligonucleotide
  Target: ATXN1; (+) strand; PAM type: YTN; PAM sequence: CTT
aaaatgaaacaaatacaagt

SEQ ID NO: 298988 - DNA, 20 bp, Artificial Sequence
  Description of Artificial Sequence: Synthetic oligonucleotide
  Target: ATXN1; (+) strand; PAM type: YTN; PAM sequence: TTA
aaatgaaacaaatacaagta

SEQ ID NO: 298989 - DNA, 20 bp, Artificial Sequence
  Description of Artificial Sequence: Synthetic oligonucleotide
  Target: ATXN1; (+) strand; PAM type: YTN; PAM sequence: TTT
ttcactgttatatacaaggc

SEQ ID NO: 298990 - DNA, 20 bp, Artificial Sequence
  Description of Artificial Sequence: Synthetic oligonucleotide
  Target: ATXN1; (+) strand; PAM type: YTN; PAM sequence: TTT
tcactgttatatacaaggca

SEQ ID NO: 298991 - DNA, 20 bp, Artificial Sequence
  Description of Artificial Sequence: Synthetic oligonucleotide
  Target: ATXN1; (+) strand; PAM type: YTN; PAM sequence: TTT
cactgttatatacaaggcag

SEQ ID NO: 298992 - DNA, 20 bp, Artificial Sequence
  Description of Artificial Sequence: Synthetic oligonucleotide
  Target: ATXN1; (+) strand; PAM type: YTN; PAM sequence: TTC
actgttatatacaaggcagc

SEQ ID NO: 298993 - DNA, 20 bp, Artificial Sequence
  Description of Artificial Sequence: Synthetic oligonucleotide
  Target: ATXN1; (+) strand; PAM type: YTN; PAM sequence: CTG
ttatatacaaggcagcctat

SEQ ID NO: 298994 - DNA, 20 bp, Artificial Sequence
  Description of Artificial Sequence: Synthetic oligonucleotide
  Target: ATXN1; (+) strand; PAM type: YTN; PAM sequence: TTA
tatacaaggcagcctattgg

SEQ ID NO: 298995 - DNA, 20 bp, Artificial Sequence
  Description of Artificial Sequence: Synthetic oligonucleotide
  Target: ATXN1; (+) strand; PAM type: YTN; PAM sequence: CTA
ttggccacataattcttaaa

SEQ ID NO: 298996 - DNA, 20 bp, Artificial Sequence
  Description of Artificial Sequence: Synthetic oligonucleotide
  Target: ATXN1; (+) strand; PAM type: YTN; PAM sequence: TTG
gccacataattcttaaacaa

SEQ ID NO: 298997 - DNA, 20 bp, Artificial Sequence
  Description of Artificial Sequence: Synthetic oligonucleotide
  Target: ATXN1; (+) strand; PAM type: YTN; PAM sequence: TTC
ttaaacaaccagaaaaaagc

SEQ ID NO: 298998 - DNA, 20 bp, Artificial Sequence
  Description of Artificial Sequence: Synthetic oligonucleotide
  Target: ATXN1; (+) strand; PAM type: YTN; PAM sequence: CTT
aaacaaccagaaaaaagctg

SEQ ID NO: 298999 - DNA, 20 bp, Artificial Sequence
  Description of Artificial Sequence: Synthetic oligonucleotide
  Target: ATXN1; (+) strand; PAM type: YTN; PAM sequence: TTA
aacaaccagaaaaaagctga

SEQ ID NO: 299000 - DNA, 20 bp, Artificial Sequence
  Description of Artificial Sequence: Synthetic oligonucleotide
  Target: ATXN1; (+) strand; PAM type: YTN; PAM sequence: CTG
aagtatgaccatcaatacgg

SEQ ID NO: 299001 - DNA, 20 bp, Artificial Sequence
  Description of Artificial Sequence: Synthetic oligonucleotide
  Target: ATXN1; (+) strand; PAM type: YTN; PAM sequence: TTC
tttcttccccctctttagga

SEQ ID NO: 299002 - DNA, 20 bp, Artificial Sequence
  Description of Artificial Sequence: Synthetic oligonucleotide
  Target: ATXN1; (+) strand; PAM type: YTN; PAM sequence: CTT
tcttccccctctttaggact

SEQ ID NO: 299003 - DNA, 20 bp, Artificial Sequence
  Description of Artificial Sequence: Synthetic oligonucleotide
  Target: ATXN1; (+) strand; PAM type: YTN; PAM sequence: TTT
cttccccctctttaggacta

SEQ ID NO: 299004 - DNA, 20 bp, Artificial Sequence
  Description of Artificial Sequence: Synthetic oligonucleotide
  Target: ATXN1; (+) strand; PAM type: YTN; PAM sequence: TTC
ttccccctctttaggactaa

SEQ ID NO: 299005 - DNA, 20 bp, Artificial Sequence
  Description of Artificial Sequence: Synthetic oligonucleotide
  Target: ATXN1; (+) strand; PAM type: YTN; PAM sequence: CTT
ccccctctttaggactaaac

SEQ ID NO: 299006 - DNA, 20 bp, Artificial Sequence
  Description of Artificial Sequence: Synthetic oligonucleotide
  Target: ATXN1; (+) strand; PAM type: YTN; PAM sequence: TTC
cccctctttaggactaaaca

SEQ ID NO: 299007 - DNA, 20 bp, Artificial Sequence
  Description of Artificial Sequence: Synthetic oligonucleotide
  Target: ATXN1; (+) strand; PAM type: YTN; PAM sequence: CTC
tttaggactaaacagctgtg

SEQ ID NO: 299008 - DNA, 20 bp, Artificial Sequence
  Description of Artificial Sequence: Synthetic oligonucleotide
  Target: ATXN1; (+) strand; PAM type: YTN; PAM sequence: CTT
taggactaaacagctgtggg

SEQ ID NO: 299009 - DNA, 20 bp, Artificial Sequence
  Description of Artificial Sequence: Synthetic oligonucleotide
  Target: ATXN1; (+) strand; PAM type: YTN; PAM sequence: TTT
aggactaaacagctgtgggc

SEQ ID NO: 299010 - DNA, 20 bp, Artificial Sequence
  Description of Artificial Sequence: Synthetic oligonucleotide
  Target: ATXN1; (+) strand; PAM type: YTN; PAM sequence: TTA
ggactaaacagctgtgggca

SEQ ID NO: 299011 - DNA, 20 bp, Artificial Sequence
  Description of Artificial Sequence: Synthetic oligonucleotide
  Target: ATXN1; (+) strand; PAM type: YTN; PAM sequence: CTA
aacagctgtgggcataaaga

SEQ ID NO: 299012 - DNA, 20 bp, Artificial Sequence
  Description of Artificial Sequence: Synthetic oligonucleotide
  Target: ATXN1; (+) strand; PAM type: YTN; PAM sequence: CTG
tgggcataaagaaaaaataa

SEQ ID NO: 299013 - DNA, 20 bp, Artificial Sequence
  Description of Artificial Sequence: Synthetic oligonucleotide
  Target: ATXN1; (+) strand; PAM type: YTN; PAM sequence: TTC
cattattttagaaagcataa

SEQ ID NO: 299014 - DNA, 20 bp, Artificial Sequence
  Description of Artificial Sequence: Synthetic oligonucleotide
  Target: ATXN1; (+) strand; PAM type: YTN; PAM sequence: TTA
ttttagaaagcataatattc

SEQ ID NO: 299015 - DNA, 20 bp, Artificial Sequence
  Description of Artificial Sequence: Synthetic oligonucleotide
  Target: ATXN1; (+) strand; PAM type: YTN; PAM sequence: TTT
tagaaagcataatattccac

SEQ ID NO: 299016 - DNA, 20 bp, Artificial Sequence
  Description of Artificial Sequence: Synthetic oligonucleotide
  Target: ATXN1; (+) strand; PAM type: YTN; PAM sequence: TTT
agaaagcataatattccacc

SEQ ID NO: 299017 - DNA, 20 bp, Artificial Sequence
  Description of Artificial Sequence: Synthetic oligonucleotide
  Target: ATXN1; (+) strand; PAM type: YTN; PAM sequence: TTA
gaaagcataatattccaccc

SEQ ID NO: 299018 - DNA, 20 bp, Artificial Sequence
  Description of Artificial Sequence: Synthetic oligonucleotide
  Target: ATXN1; (+) strand; PAM type: YTN; PAM sequence: TTC
cacccttcattatttctttg

SEQ ID NO: 299019 - DNA, 20 bp, Artificial Sequence
  Description of Artificial Sequence: Synthetic oligonucleotide
  Target: ATXN1; (+) strand; PAM type: YTN; PAM sequence: CTT
cattatttctttgagaatgg

SEQ ID NO: 299020 - DNA, 20 bp, Artificial Sequence
  Description of Artificial Sequence: Synthetic oligonucleotide
  Target: ATXN1; (+) strand; PAM type: YTN; PAM sequence: TTC
attatttctttgagaatggt

SEQ ID NO: 299021 - DNA, 20 bp, Artificial Sequence
  Description of Artificial Sequence: Synthetic oligonucleotide
  Target: ATXN1; (+) strand; PAM type: YTN; PAM sequence: TTA
tttctttgagaatggttgga

SEQ ID NO: 299022 - DNA, 20 bp, Artificial Sequence
  Description of Artificial Sequence: Synthetic oligonucleotide
  Target: ATXN1; (+) strand; PAM type: YTN; PAM sequence: TTT
ctttgagaatggttggaatt

SEQ ID NO: 299023 - DNA, 20 bp, Artificial Sequence
  Description of Artificial Sequence: Synthetic oligonucleotide
  Target: ATXN1; (+) strand; PAM type: YTN; PAM sequence: TTC
tttgagaatggttggaatta

SEQ ID NO: 299024 - DNA, 20 bp, Artificial Sequence
  Description of Artificial Sequence: Synthetic oligonucleotide
  Target: ATXN1; (+) strand; PAM type: YTN; PAM sequence: CTT
tgagaatggttggaattatt

SEQ ID NO: 299025 - DNA, 20 bp, Artificial Sequence
  Description of Artificial Sequence: Synthetic oligonucleotide
  Target: ATXN1; (+) strand; PAM type: YTN; PAM sequence: TTT
gagaatggttggaattatta

SEQ ID NO: 299026 - DNA, 20 bp, Artificial Sequence
  Description of Artificial Sequence: Synthetic oligonucleotide
  Target: ATXN1; (+) strand; PAM type: YTN; PAM sequence: TTG
agaatggttggaattattac

SEQ ID NO: 299027 - DNA, 20 bp, Artificial Sequence
  Description of Artificial Sequence: Synthetic oligonucleotide
  Target: ATXN1; (+) strand; PAM type: YTN; PAM sequence: TTG
gaattattacatctacgaga

SEQ ID NO: 299028 - DNA, 20 bp, Artificial Sequence
  Description of Artificial Sequence: Synthetic oligonucleotide
  Target: ATXN1; (+) strand; PAM type: YTN; PAM sequence: TTA
ttacatctacgagaggttag

SEQ ID NO: 299029 - DNA, 20 bp, Artificial Sequence
  Description of Artificial Sequence: Synthetic oligonucleotide
  Target: ATXN1; (+) strand; PAM type: YTN; PAM sequence: TTA
catctacgagaggttagcct

SEQ ID NO: 299030 - DNA, 20 bp, Artificial Sequence
  Description of Artificial Sequence: Synthetic oligonucleotide
  Target: ATXN1; (+) strand; PAM type: YTN; PAM sequence: CTA
cgagaggttagcctctatcg

SEQ ID NO: 299031 - DNA, 20 bp, Artificial Sequence
  Description of Artificial Sequence: Synthetic oligonucleotide
  Target: ATXN1; (+) strand; PAM type: YTN; PAM sequence: TTA
gcctctatcgattgagtgat

SEQ ID NO: 299032 - DNA, 20 bp, Artificial Sequence
  Description of Artificial Sequence: Synthetic oligonucleotide
  Target: ATXN1; (+) strand; PAM type: YTN; PAM sequence: CTC
tatcgattgagtgatttcat

SEQ ID NO: 299033 - DNA, 20 bp, Artificial Sequence
  Description of Artificial Sequence: Synthetic oligonucleotide
  Target: ATXN1; (+) strand; PAM type: YTN; PAM sequence: CTA
tcgattgagtgatttcatta

SEQ ID NO: 299034 - DNA, 20 bp, Artificial Sequence
  Description of Artificial Sequence: Synthetic oligonucleotide
  Target: ATXN1; (+) strand; PAM type: YTN; PAM sequence: TTG
agtgatttcattaaaaaaat

SEQ ID NO: 299035 - DNA, 20 bp, Artificial Sequence
  Description of Artificial Sequence: Synthetic oligonucleotide
  Target: ATXN1; (+) strand; PAM type: YTN; PAM sequence: TTT
cattaaaaaaattaaaccag

SEQ ID NO: 299036 - DNA, 20 bp, Artificial Sequence
  Description of Artificial Sequence: Synthetic oligonucleotide
  Target: ATXN1; (+) strand; PAM type: YTN; PAM sequence: TTC
attaaaaaaattaaaccagt

SEQ ID NO: 299037 - DNA, 20 bp, Artificial Sequence
  Description of Artificial Sequence: Synthetic oligonucleotide
  Target: ATXN1; (+) strand; PAM type: YTN; PAM sequence: TTA
aaaaaattaaaccagtgatt

SEQ ID NO: 299038 - DNA, 20 bp, Artificial Sequence
  Description of Artificial Sequence: Synthetic oligonucleotide
  Target: ATXN1; (+) strand; PAM type: YTN; PAM sequence: TTA
aaccagtgattgagctaaaa

SEQ ID NO: 299039 - DNA, 20 bp, Artificial Sequence
  Description of Artificial Sequence: Synthetic oligonucleotide
  Target: ATXN1; (+) strand; PAM type: YTN; PAM sequence: TTG
agctaaaatgagtggccaag

SEQ ID NO: 299040 - DNA, 20 bp, Artificial Sequence
  Description of Artificial Sequence: Synthetic oligonucleotide
  Target: ATXN1; (+) strand; PAM type: YTN; PAM sequence: CTA
aaatgagtggccaagctaca

SEQ ID NO: 299041 - DNA, 20 bp, Artificial Sequence
  Description of Artificial Sequence: Synthetic oligonucleotide
  Target: ATXN1; (+) strand; PAM type: YTN; PAM sequence: CTA
caagaccaaaaattgtgtgt

SEQ ID NO: 299042 - DNA, 20 bp, Artificial Sequence
  Description of Artificial Sequence: Synthetic oligonucleotide
  Target: ATXN1; (+) strand; PAM type: YTN; PAM sequence: TTG
tgtgtggtcaacaggtgaga

SEQ ID NO: 299043 - DNA, 20 bp, Artificial Sequence
  Description of Artificial Sequence: Synthetic oligonucleotide
  Target: ATXN1; (+) strand; PAM type: YTN; PAM sequence: CTA
cctaatcaattccaaaggaa

SEQ ID NO: 299044 - DNA, 20 bp, Artificial Sequence
  Description of Artificial Sequence: Synthetic oligonucleotide
  Target: ATXN1; (+) strand; PAM type: YTN; PAM sequence: CTA
atcaattccaaaggaaggga

SEQ ID NO: 299045 - DNA, 20 bp, Artificial Sequence
  Description of Artificial Sequence: Synthetic oligonucleotide
  Target: ATXN1; (+) strand; PAM type: YTN; PAM sequence: TTC
caaaggaagggagacatgat

SEQ ID NO: 299046 - DNA, 20 bp, Artificial Sequence
  Description of Artificial Sequence: Synthetic oligonucleotide
  Target: ATXN1; (+) strand; PAM type: YTN; PAM sequence: TTG
ttatttctccccaccaatgg

SEQ ID NO: 299047 - DNA, 20 bp, Artificial Sequence
  Description of Artificial Sequence: Synthetic oligonucleotide
  Target: ATXN1; (+) strand; PAM type: YTN; PAM sequence: TTA
tttctccccaccaatgggac

SEQ ID NO: 299048 - DNA, 20 bp, Artificial Sequence
  Description of Artificial Sequence: Synthetic oligonucleotide
  Target: ATXN1; (+) strand; PAM type: YTN; PAM sequence: TTT
ctccccaccaatgggacagt

SEQ ID NO: 299049 - DNA, 20 bp, Artificial Sequence
  Description of Artificial Sequence: Synthetic oligonucleotide
  Target: ATXN1; (+) strand; PAM type: YTN; PAM sequence: TTC
tccccaccaatgggacagtg

SEQ ID NO: 299050 - DNA, 20 bp, Artificial Sequence
  Description of Artificial Sequence: Synthetic oligonucleotide
  Target: ATXN1; (+) strand; PAM type: YTN; PAM sequence: CTC
cccaccaatgggacagtgct

SEQ ID NO: 299051 - DNA, 20 bp, Artificial Sequence
  Description of Artificial Sequence: Synthetic oligonucleotide
  Target: ATXN1; (+) strand; PAM type: YTN; PAM sequence: CTC
cagtagaccccaggatcttc

SEQ ID NO: 299052 - DNA, 20 bp, Artificial Sequence
  Description of Artificial Sequence: Synthetic oligonucleotide
  Target: ATXN1; (+) strand; PAM type: YTN; PAM sequence: CTT
ctatttaatggctgttgtaa

SEQ ID NO: 299053 - DNA, 20 bp, Artificial Sequence
  Description of Artificial Sequence: Synthetic oligonucleotide
  Target: ATXN1; (+) strand; PAM type: YTN; PAM sequence: TTC
tatttaatggctgttgtaag

SEQ ID NO: 299054 - DNA, 20 bp, Artificial Sequence
  Description of Artificial Sequence: Synthetic oligonucleotide
  Target: ATXN1; (+) strand; PAM type: YTN; PAM sequence: CTA
tttaatggctgttgtaagac

SEQ ID NO: 299055 - DNA, 20 bp, Artificial Sequence
  Description of Artificial Sequence: Synthetic oligonucleotide
  Target: ATXN1; (+) strand; PAM type: YTN; PAM sequence: TTT
aatggctgttgtaagactct

SEQ ID NO: 299056 - DNA, 20 bp, Artificial Sequence
  Description of Artificial Sequence: Synthetic oligonucleotide
  Target: ATXN1; (+) strand; PAM type: YTN; PAM sequence: TTA
atggctgttgtaagactcta

SEQ ID NO: 299057 - DNA, 20 bp, Artificial Sequence
  Description of Artificial Sequence: Synthetic oligonucleotide
  Target: ATXN1; (+) strand; PAM type: YTN; PAM sequence: CTG
ttgtaagactctatctctgt

SEQ ID NO: 299058 - DNA, 20 bp, Artificial Sequence
  Description of Artificial Sequence: Synthetic oligonucleotide
  Target: ATXN1; (+) strand; PAM type: YTN; PAM sequence: TTG
taagactctatctctgttcc

SEQ ID NO: 299059 - DNA, 20 bp, Artificial Sequence
  Description of Artificial Sequence: Synthetic oligonucleotide
  Target: ATXN1; (+) strand; PAM type: YTN; PAM sequence: CTC
tatctctgttcctcttggaa

SEQ ID NO: 299060 - DNA, 20 bp, Artificial Sequence
  Description of Artificial Sequence: Synthetic oligonucleotide
  Target: ATXN1; (+) strand; PAM type: YTN; PAM sequence: CTA
tctctgttcctcttggaaga

SEQ ID NO: 299061 - DNA, 20 bp, Artificial Sequence
  Description of Artificial Sequence: Synthetic oligonucleotide
  Target: ATXN1; (+) strand; PAM type: YTN; PAM sequence: CTC
tgttcctcttggaagaaaag

SEQ ID NO: 299062 - DNA, 20 bp, Artificial Sequence
  Description of Artificial Sequence: Synthetic oligonucleotide
  Target: ATXN1; (+) strand; PAM type: YTN; PAM sequence: CTG
ttcctcttggaagaaaaggt

SEQ ID NO: 299063 - DNA, 20 bp, Artificial Sequence
  Description of Artificial Sequence: Synthetic oligonucleotide
  Target: ATXN1; (+) strand; PAM type: YTN; PAM sequence: TTC
ctcttggaagaaaaggtgcc

SEQ ID NO: 299064 - DNA, 20 bp, Artificial Sequence
  Description of Artificial Sequence: Synthetic oligonucleotide
  Target: ATXN1; (+) strand; PAM type: YTN; PAM sequence: CTC
ttggaagaaaaggtgccact

SEQ ID NO: 299065 - DNA, 20 bp, Artificial Sequence
  Description of Artificial Sequence: Synthetic oligonucleotide
  Target: ATXN1; (+) strand; PAM type: YTN; PAM sequence: CTT
ggaagaaaaggtgccactga

SEQ ID NO: 299066 - DNA, 20 bp, Artificial Sequence
  Description of Artificial Sequence: Synthetic oligonucleotide
  Target: ATXN1; (+) strand; PAM type: YTN; PAM sequence: TTG
gaagaaaaggtgccactgag

SEQ ID NO: 299067 - DNA, 20 bp, Artificial Sequence
  Description of Artificial Sequence: Synthetic oligonucleotide
  Target: ATXN1; (+) strand; PAM type: YTN; PAM sequence: CTG
aggacaagggaacaagaatc

SEQ ID NO: 299068 - DNA, 20 bp, Artificial Sequence
  Description of Artificial Sequence: Synthetic oligonucleotide
  Target: ATXN1; (+) strand; PAM type: YTN; PAM sequence: CTG
tgtcaatcaacaatgcccct

SEQ ID NO: 299069 - DNA, 20 bp, Artificial Sequence
  Description of Artificial Sequence: Synthetic oligonucleotide
  Target: ATXN1; (+) strand; PAM type: YTN; PAM sequence: CTG
aagtaaaccaggcaggtccg

SEQ ID NO: 299070 - DNA, 20 bp, Artificial Sequence
  Description of Artificial Sequence: Synthetic oligonucleotide
  Target: ATXN1; (+) strand; PAM type: YTN; PAM sequence: CTG
cacagtctcagctgtaattc

SEQ ID NO: 299071 - DNA, 20 bp, Artificial Sequence
  Description of Artificial Sequence: Synthetic oligonucleotide
  Target: ATXN1; (+) strand; PAM type: YTN; PAM sequence: CTC
agctgtaattctatcccaag

SEQ ID NO: 299072 - DNA, 20 bp, Artificial Sequence
  Description of Artificial Sequence: Synthetic oligonucleotide
  Target: ATXN1; (+) strand; PAM type: YTN; PAM sequence: CTG
taattctatcccaagaaacc

SEQ ID NO: 299073 - DNA, 20 bp, Artificial Sequence
  Description of Artificial Sequence: Synthetic oligonucleotide
  Target: ATXN1; (+) strand; PAM type: YTN; PAM sequence: TTC
tatcccaagaaaccagagca

SEQ ID NO: 299074 - DNA, 20 bp, Artificial Sequence
  Description of Artificial Sequence: Synthetic oligonucleotide
  Target: ATXN1; (+) strand; PAM type: YTN; PAM sequence: CTA
tcccaagaaaccagagcaca

SEQ ID NO: 299075 - DNA, 20 bp, Artificial Sequence
  Description of Artificial Sequence: Synthetic oligonucleotide
  Target: ATXN1; (+) strand; PAM type: YTN; PAM sequence: CTT
aagcctgcagtgtagggtga

SEQ ID NO: 299076 - DNA, 20 bp, Artificial Sequence
  Description of Artificial Sequence: Synthetic oligonucleotide
  Target: ATXN1; (+) strand; PAM type: YTN; PAM sequence: TTA
agcctgcagtgtagggtgac

SEQ ID NO: 299077 - DNA, 20 bp, Artificial Sequence
  Description of Artificial Sequence: Synthetic oligonucleotide
  Target: ATXN1; (+) strand; PAM type: YTN; PAM sequence: CTG
cagtgtagggtgacgccatg

SEQ ID NO: 299078 - DNA, 20 bp, Artificial Sequence
  Description of Artificial Sequence: Synthetic oligonucleotide
  Target: ATXN1; (+) strand; PAM type: YTN; PAM sequence: CTG
cctctccaaagctgttactg

SEQ ID NO: 299079 - DNA, 20 bp, Artificial Sequence
  Description of Artificial Sequence: Synthetic oligonucleotide
  Target: ATXN1; (+) strand; PAM type: YTN; PAM sequence: CTC
tccaaagctgttactgtcag

SEQ ID NO: 299080 - DNA, 20 bp, Artificial Sequence
  Description of Artificial Sequence: Synthetic oligonucleotide
  Target: ATXN1; (+) strand; PAM type: YTN; PAM sequence: CTC
caaagctgttactgtcagta

SEQ ID NO: 299081 - DNA, 20 bp, Artificial Sequence
  Description of Artificial Sequence: Synthetic oligonucleotide
  Target: ATXN1; (+) strand; PAM type: YTN; PAM sequence: CTG
ttactgtcagtagtatttag

SEQ ID NO: 299082 - DNA, 20 bp, Artificial Sequence
  Description of Artificial Sequence: Synthetic oligonucleotide
  Target: ATXN1; (+) strand; PAM type: YTN; PAM sequence: TTA
ctgtcagtagtatttagagg

SEQ ID NO: 299083 - DNA, 20 bp, Artificial Sequence
  Description of Artificial Sequence: Synthetic oligonucleotide
  Target: ATXN1; (+) strand; PAM type: YTN; PAM sequence: CTG
tcagtagtatttagaggaaa

SEQ ID NO: 299084 - DNA, 20 bp, Artificial Sequence
  Description of Artificial Sequence: Synthetic oligonucleotide
  Target: ATXN1; (+) strand; PAM type: YTN; PAM sequence: TTT
agaggaaaggaaaaaagttg

SEQ ID NO: 299085 - DNA, 20 bp, Artificial Sequence
  Description of Artificial Sequence: Synthetic oligonucleotide
  Target: ATXN1; (+) strand; PAM type: YTN; PAM sequence: TTA
gaggaaaggaaaaaagttgt

SEQ ID NO: 299086 - DNA, 20 bp, Artificial Sequence
  Description of Artificial Sequence: Synthetic oligonucleotide
  Target: ATXN1; (+) strand; PAM type: YTN; PAM sequence: TTG
taacaagtgtaacacgaaca

SEQ ID NO: 299087 - DNA, 20 bp, Artificial Sequence
  Description of Artificial Sequence: Synthetic oligonucleotide
  Target: ATXN1; (+) strand; PAM type: YTN; PAM sequence: TTA
aggaataccaagtcagagcc

SEQ ID NO: 299088 - DNA, 20 bp, Artificial Sequence
  Description of Artificial Sequence: Synthetic oligonucleotide
  Target: ATXN1; (+) strand; PAM type: YTN; PAM sequence: TTA
ggacgataatttggcactcc

SEQ ID NO: 299089 - DNA, 20 bp, Artificial Sequence
  Description of Artificial Sequence: Synthetic oligonucleotide
  Target: ATXN1; (+) strand; PAM type: YTN; PAM sequence: TTT
ggcactcctgcctcatgcat

SEQ ID NO: 299090 - DNA, 20 bp, Artificial Sequence
  Description of Artificial Sequence: Synthetic oligonucleotide
  Target: ATXN1; (+) strand; PAM type: YTN; PAM sequence: TTG
gcactcctgcctcatgcata

SEQ ID NO: 299091 - DNA, 20 bp, Artificial Sequence
  Description of Artificial Sequence: Synthetic oligonucleotide
  Target: ATXN1; (+) strand; PAM type: YTN; PAM sequence: CTC
ctgcctcatgcatatgaaaa

SEQ ID NO: 299092 - DNA, 20 bp, Artificial Sequence
  Description of Artificial Sequence: Synthetic oligonucleotide
  Target: ATXN1; (+) strand; PAM type: YTN; PAM sequence: CTG
cctcatgcatatgaaaaagg

SEQ ID NO: 299093 - DNA, 20 bp, Artificial Sequence
  Description of Artificial Sequence: Synthetic oligonucleotide
  Target: ATXN1; (+) strand; PAM type: YTN; PAM sequence: CTC
atgcatatgaaaaaggatcc

SEQ ID NO: 299094 - DNA, 20 bp, Artificial Sequence
  Description of Artificial Sequence: Synthetic oligonucleotide
  Target: ATXN1; (+) strand; PAM type: YTN; PAM sequence: TTT
gtgggaatgctctaacttca

SEQ ID NO: 299095 - DNA, 20 bp, Artificial Sequence
  Description of Artificial Sequence: Synthetic oligonucleotide
  Target: ATXN1; (+) strand; PAM type: YTN; PAM sequence: TTG
tgggaatgctctaacttcaa

SEQ ID NO: 299096 - DNA, 20 bp, Artificial Sequence
  Description of Artificial Sequence: Synthetic oligonucleotide
  Target: ATXN1; (+) strand; PAM type: YTN; PAM sequence: CTC
taacttcaatacatcaaaga

SEQ ID NO: 299097 - DNA, 20 bp, Artificial Sequence
  Description of Artificial Sequence: Synthetic oligonucleotide
  Target: ATXN1; (+) strand; PAM type: YTN; PAM sequence: CTA
acttcaatacatcaaagacg

SEQ ID NO: 299098 - DNA, 20 bp, Artificial Sequence
  Description of Artificial Sequence: Synthetic oligonucleotide
  Target: ATXN1; (+) strand; PAM type: YTN; PAM sequence: CTT
caatacatcaaagacgctgc

SEQ ID NO: 299099 - DNA, 20 bp, Artificial Sequence
  Description of Artificial Sequence: Synthetic oligonucleotide
  Target: ATXN1; (+) strand; PAM type: YTN; PAM sequence: TTC
aatacatcaaagacgctgct

SEQ ID NO: 299100 - DNA, 20 bp, Artificial Sequence
  Description of Artificial Sequence: Synthetic oligonucleotide
  Target: ATXN1; (+) strand; PAM type: YTN; PAM sequence: CTG
ctgcacacctccgtcttttt

SEQ ID NO: 299101 - DNA, 20 bp, Artificial Sequence
  Description of Artificial Sequence: Synthetic oligonucleotide
  Target: ATXN1; (+) strand; PAM type: YTN; PAM sequence: CTG
cacacctccgtcttttttat

SEQ ID NO: 299102 - DNA, 20 bp, Artificial Sequence
  Description of Artificial Sequence: Synthetic oligonucleotide
  Target: ATXN1; (+) strand; PAM type: YTN; PAM sequence: CTC
cgtcttttttattcccatta

SEQ ID NO: 299103 - DNA, 20 bp, Artificial Sequence
  Description of Artificial Sequence: Synthetic oligonucleotide
  Target: ATXN1; (+) strand; PAM type: YTN; PAM sequence: CTT
ttttattcccattagctcac

SEQ ID NO: 299104 - DNA, 20 bp, Artificial Sequence
  Description of Artificial Sequence: Synthetic oligonucleotide
  Target: ATXN1; (+) strand; PAM type: YTN; PAM sequence: TTT
tttattcccattagctcacc

SEQ ID NO: 299105 - DNA, 20 bp, Artificial Sequence
  Description of Artificial Sequence: Synthetic oligonucleotide
  Target: ATXN1; (+) strand; PAM type: YTN; PAM sequence: TTT
ttattcccattagctcaccc

SEQ ID NO: 299106 - DNA, 20 bp, Artificial Sequence
  Description of Artificial Sequence: Synthetic oligonucleotide
  Target: ATXN1; (+) strand; PAM type: YTN; PAM sequence: TTT
tattcccattagctcaccct

SEQ ID NO: 299107 - DNA, 20 bp, Artificial Sequence
  Description of Artificial Sequence: Synthetic oligonucleotide
  Target: ATXN1; (+) strand; PAM type: YTN; PAM sequence: TTT
attcccattagctcaccctt

SEQ ID NO: 299108 - DNA, 20 bp, Artificial Sequence
  Description of Artificial Sequence: Synthetic oligonucleotide
  Target: ATXN1; (+) strand; PAM type: YTN; PAM sequence: TTA
ttcccattagctcacccttg

SEQ ID NO: 299109 - DNA, 20 bp, Artificial Sequence
  Description of Artificial Sequence: Synthetic oligonucleotide
  Target: ATXN1; (+) strand; PAM type: YTN; PAM sequence: TTC
ccattagctcacccttgtct

SEQ ID NO: 299110 - DNA, 20 bp, Artificial Sequence
  Description of Artificial Sequence: Synthetic oligonucleotide
  Target: ATXN1; (+) strand; PAM type: YTN; PAM sequence: TTA
gctcacccttgtctggatga

SEQ ID NO: 299111 - DNA, 20 bp, Artificial Sequence
  Description of Artificial Sequence: Synthetic oligonucleotide
  Target: ATXN1; (+) strand; PAM type: YTN; PAM sequence: CTC
acccttgtctggatgaaaga

SEQ ID NO: 299112 - DNA, 20 bp, Artificial Sequence
  Description of Artificial Sequence: Synthetic oligonucleotide
  Target: ATXN1; (+) strand; PAM type: YTN; PAM sequence: CTT
gtctggatgaaagagctcag

SEQ ID NO: 299113 - DNA, 20 bp, Artificial Sequence
  Description of Artificial Sequence: Synthetic oligonucleotide
  Target: ATXN1; (+) strand; PAM type: YTN; PAM sequence: TTG
tctggatgaaagagctcagt

SEQ ID NO: 299114 - DNA, 20 bp, Artificial Sequence
  Description of Artificial Sequence: Synthetic oligonucleotide
  Target: ATXN1; (+) strand; PAM type: YTN; PAM sequence: CTG
gatgaaagagctcagtgaat

SEQ ID NO: 299115 - DNA, 20 bp, Artificial Sequence
  Description of Artificial Sequence: Synthetic oligonucleotide
  Target: ATXN1; (+) strand; PAM type: YTN; PAM sequence: CTC
agtgaatcaactgcttctgt

SEQ ID NO: 299116 - DNA, 20 bp, Artificial Sequence
  Description of Artificial Sequence: Synthetic oligonucleotide
  Target: ATXN1; (+) strand; PAM type: YTN; PAM sequence: CTG
cttctgttgaactgtttata

SEQ ID NO: 299117 - DNA, 20 bp, Artificial Sequence
  Description of Artificial Sequence: Synthetic oligonucleotide
  Target: ATXN1; (+) strand; PAM type: YTN; PAM sequence: CTT
ctgttgaactgtttatatat

SEQ ID NO: 299118 - DNA, 20 bp, Artificial Sequence
  Description of Artificial Sequence: Synthetic oligonucleotide
  Target: ATXN1; (+) strand; PAM type: YTN; PAM sequence: TTC
tgttgaactgtttatatatt

SEQ ID NO: 299119 - DNA, 20 bp, Artificial Sequence
  Description of Artificial Sequence: Synthetic oligonucleotide
  Target: ATXN1; (+) strand; PAM type: YTN; PAM sequence: CTG
ttgaactgtttatatatttt

SEQ ID NO: 299120 - DNA, 20 bp, Artificial Sequence
  Description of Artificial Sequence: Synthetic oligonucleotide
  Target: ATXN1; (+) strand; PAM type: YTN; PAM sequence: TTG
aactgtttatatatttttca

SEQ ID NO: 299121 - DNA, 20 bp, Artificial Sequence
  Description of Artificial Sequence: Synthetic oligonucleotide
  Target: ATXN1; (+) strand; PAM type: YTN; PAM sequence: CTG
tttatatatttttcaagtca

SEQ ID NO: 299122 - DNA, 20 bp, Artificial Sequence
  Description of Artificial Sequence: Synthetic oligonucleotide
  Target: ATXN1; (+) strand; PAM type: YTN; PAM sequence: TTT
atatatttttcaagtcatga

SEQ ID NO: 299123 - DNA, 20 bp, Artificial Sequence
  Description of Artificial Sequence: Synthetic oligonucleotide
  Target: ATXN1; (+) strand; PAM type: YTN; PAM sequence: TTA
tatatttttcaagtcatgat

SEQ ID NO: 299124 - DNA, 20 bp, Artificial Sequence
  Description of Artificial Sequence: Synthetic oligonucleotide
  Target: ATXN1; (+) strand; PAM type: YTN; PAM sequence: TTT
ttcaagtcatgattaggcca

SEQ ID NO: 299125 - DNA, 20 bp, Artificial Sequence
  Description of Artificial Sequence: Synthetic oligonucleotide
  Target: ATXN1; (+) strand; PAM type: YTN; PAM sequence: TTT
tcaagtcatgattaggccat

SEQ ID NO: 299126 - DNA, 20 bp, Artificial Sequence
  Description of Artificial Sequence: Synthetic oligonucleotide
  Target: ATXN1; (+) strand; PAM type: YTN; PAM sequence: TTT
caagtcatgattaggccatt

SEQ ID NO: 299127 - DNA, 20 bp, Artificial Sequence
  Description of Artificial Sequence: Synthetic oligonucleotide
  Target: ATXN1; (+) strand; PAM type: YTN; PAM sequence: TTC
aagtcatgattaggccatta

SEQ ID NO: 299128 - DNA, 20 bp, Artificial Sequence
  Description of Artificial Sequence: Synthetic oligonucleotide
  Target: ATXN1; (+) strand; PAM type: YTN; PAM sequence: TTA
ggccattagtcactgagcat

SEQ ID NO: 299129 - DNA, 20 bp, Artificial Sequence
  Description of Artificial Sequence: Synthetic oligonucleotide
  Target: ATXN1; (+) strand; PAM type: YTN; PAM sequence: TTA
gtcactgagcatattgcaca

SEQ ID NO: 299130 - DNA, 20 bp, Artificial Sequence
  Description of Artificial Sequence: Synthetic oligonucleotide
  Target: ATXN1; (+) strand; PAM type: YTN; PAM sequence: CTG
agcatattgcacagtaaact

SEQ ID NO: 299131 - DNA, 20 bp, Artificial Sequence
  Description of Artificial Sequence: Synthetic oligonucleotide
  Target: ATXN1; (+) strand; PAM type: YTN; PAM sequence: TTG
cacagtaaactagagtaact

SEQ ID NO: 299132 - DNA, 20 bp, Artificial Sequence
  Description of Artificial Sequence: Synthetic oligonucleotide
  Target: ATXN1; (+) strand; PAM type: YTN; PAM sequence: CTA
gagtaactgccattatgcaa

SEQ ID NO: 299133 - DNA, 20 bp, Artificial Sequence
  Description of Artificial Sequence: Synthetic oligonucleotide
  Target: ATXN1; (+) strand; PAM type: YTN; PAM sequence: CTG
ccattatgcaacttcccaag

SEQ ID NO: 299134 - DNA, 20 bp, Artificial Sequence
  Description of Artificial Sequence: Synthetic oligonucleotide
  Target: ATXN1; (+) strand; PAM type: YTN; PAM sequence: TTA
tgcaacttcccaagaacata

SEQ ID NO: 299135 - DNA, 20 bp, Artificial Sequence
  Description of Artificial Sequence: Synthetic oligonucleotide
  Target: ATXN1; (+) strand; PAM type: YTN; PAM sequence: CTT
cccaagaacatacagagagc

SEQ ID NO: 299136 - DNA, 20 bp, Artificial Sequence
  Description of Artificial Sequence: Synthetic oligonucleotide
  Target: ATXN1; (+) strand; PAM type: YTN; PAM sequence: TTC
ccaagaacatacagagagca

SEQ ID NO: 299137 - DNA, 20 bp, Artificial Sequence
  Description of Artificial Sequence: Synthetic oligonucleotide
  Target: ATXN1; (+) strand; PAM type: YTN; PAM sequence: TTT
acagtgaggccacagtgcca

SEQ ID NO: 299138 - DNA, 20 bp, Artificial Sequence
  Description of Artificial Sequence: Synthetic oligonucleotide
  Target: ATXN1; (+) strand; PAM type: YTN; PAM sequence: TTA
cagtgaggccacagtgccag

SEQ ID NO: 299139 - DNA, 20 bp, Artificial Sequence
  Description of Artificial Sequence: Synthetic oligonucleotide
  Target: ATXN1; (+) strand; PAM type: YTN; PAM sequence: CTA
tttatcagcaattataagaa

SEQ ID NO: 299140 - DNA, 20 bp, Artificial Sequence
  Description of Artificial Sequence: Synthetic oligonucleotide
  Target: ATXN1; (+) strand; PAM type: YTN; PAM sequence: TTT
atcagcaattataagaactg

SEQ ID NO: 299141 - DNA, 20 bp, Artificial Sequence
  Description of Artificial Sequence: Synthetic oligonucleotide
  Target: ATXN1; (+) strand; PAM type: YTN; PAM sequence: TTA
tcagcaattataagaactgt

SEQ ID NO: 299142 - DNA, 20 bp, Artificial Sequence
  Description of Artificial Sequence: Synthetic oligonucleotide
  Target: ATXN1; (+) strand; PAM type: YTN; PAM sequence: TTA
taagaactgtgcatttaaat

SEQ ID NO: 299143 - DNA, 20 bp, Artificial Sequence
  Description of Artificial Sequence: Synthetic oligonucleotide
  Target: ATXN1; (+) strand; PAM type: YTN; PAM sequence: CTG
tgcatttaaatgccaaataa

SEQ ID NO: 299144 - DNA, 20 bp, Artificial Sequence
  Description of Artificial Sequence: Synthetic oligonucleotide
  Target: ATXN1; (+) strand; PAM type: YTN; PAM sequence: TTT
aaatgccaaataaaatatac

SEQ ID NO: 299145 - DNA, 20 bp, Artificial Sequence
  Description of Artificial Sequence: Synthetic oligonucleotide
  Target: ATXN1; (+) strand; PAM type: YTN; PAM sequence: TTA
aatgccaaataaaatataca

SEQ ID NO: 299146 - DNA, 20 bp, Artificial Sequence
  Description of Artificial Sequence: Synthetic oligonucleotide
  Target: ATXN1; (+) strand; PAM type: YTN; PAM sequence: CTT
gagggggaaaagatgcatga

SEQ ID NO: 299147 - DNA, 20 bp, Artificial Sequence
  Description of Artificial Sequence: Synthetic oligonucleotide
  Target: ATXN1; (+) strand; PAM type: YTN; PAM sequence: TTG
agggggaaaagatgcatgat

SEQ ID NO: 299148 - DNA, 20 bp, Artificial Sequence
  Description of Artificial Sequence: Synthetic oligonucleotide
  Target: ATXN1; (+) strand; PAM type: YTN; PAM sequence: TTA
aagtaccaatatttgctctt

SEQ ID NO: 299149 - DNA, 20 bp, Artificial Sequence
  Description of Artificial Sequence: Synthetic oligonucleotide
  Target: ATXN1; (+) strand; PAM type: YTN; PAM sequence: TTT
gctcttctgaatgtattaga

SEQ ID NO: 299150 - DNA, 20 bp, Artificial Sequence
  Description of Artificial Sequence: Synthetic oligonucleotide
  Target: ATXN1; (+) strand; PAM type: YTN; PAM sequence: TTG
ctcttctgaatgtattagag

SEQ ID NO: 299151 - DNA, 20 bp, Artificial Sequence
  Description of Artificial Sequence: Synthetic oligonucleotide
  Target: ATXN1; (+) strand; PAM type: YTN; PAM sequence: CTC
ttctgaatgtattagagcct

SEQ ID NO: 299152 - DNA, 20 bp, Artificial Sequence
  Description of Artificial Sequence: Synthetic oligonucleotide
  Target: ATXN1; (+) strand; PAM type: YTN; PAM sequence: CTT
ctgaatgtattagagcctga

SEQ ID NO: 299153 - DNA, 20 bp, Artificial Sequence
  Description of Artificial Sequence: Synthetic oligonucleotide
  Target: ATXN1; (+) strand; PAM type: YTN; PAM sequence: TTC
tgaatgtattagagcctgaa

SEQ ID NO: 299154 - DNA, 20 bp, Artificial Sequence
  Description of Artificial Sequence: Synthetic oligonucleotide
  Target: ATXN1; (+) strand; PAM type: YTN; PAM sequence: CTG
aatgtattagagcctgaaaa

SEQ ID NO: 299155 - DNA, 20 bp, Artificial Sequence
  Description of Artificial Sequence: Synthetic oligonucleotide
  Target: ATXN1; (+) strand; PAM type: YTN; PAM sequence: TTA
gagcctgaaaacgaaagtcc

SEQ ID NO: 299156 - DNA, 20 bp, Artificial Sequence
  Description of Artificial Sequence: Synthetic oligonucleotide
  Target: ATXN1; (+) strand; PAM type: YTN; PAM sequence: CTG
aaaacgaaagtccccctgaa

SEQ ID NO: 299157 - DNA, 20 bp, Artificial Sequence
  Description of Artificial Sequence: Synthetic oligonucleotide
  Target: ATXN1; (+) strand; PAM type: YTN; PAM sequence: CTG
aaccagaagcgaatcttgaa

SEQ ID NO: 299158 - DNA, 20 bp, Artificial Sequence
  Description of Artificial Sequence: Synthetic oligonucleotide
  Target: ATXN1; (+) strand; PAM type: YTN; PAM sequence: CTT
gaactcagtctcagttagct

SEQ ID NO: 299159 - DNA, 20 bp, Artificial Sequence
  Description of Artificial Sequence: Synthetic oligonucleotide
  Target: ATXN1; (+) strand; PAM type: YTN; PAM sequence: TTG
aactcagtctcagttagctt

SEQ ID NO: 299160 - DNA, 20 bp, Artificial Sequence
  Description of Artificial Sequence: Synthetic oligonucleotide
  Target: ATXN1; (+) strand; PAM type: YTN; PAM sequence: CTC
agtctcagttagcttggtta

SEQ ID NO: 299161 - DNA, 20 bp, Artificial Sequence
  Description of Artificial Sequence: Synthetic oligonucleotide
  Target: ATXN1; (+) strand; PAM type: YTN; PAM sequence: CTC
agttagcttggttagccgct

SEQ ID NO: 299162 - DNA, 20 bp, Artificial Sequence
  Description of Artificial Sequence: Synthetic oligonucleotide
  Target: ATXN1; (+) strand; PAM type: YTN; PAM sequence: TTA
gcttggttagccgctgttct

SEQ ID NO: 299163 - DNA, 20 bp, Artificial Sequence
  Description of Artificial Sequence: Synthetic oligonucleotide
  Target: ATXN1; (+) strand; PAM type: YTN; PAM sequence: CTT
ggttagccgctgttctcctt

SEQ ID NO: 299164 - DNA, 20 bp, Artificial Sequence
  Description of Artificial Sequence: Synthetic oligonucleotide
  Target: ATXN1; (+) strand; PAM type: YTN; PAM sequence: TTG
gttagccgctgttctccttc

SEQ ID NO: 299165 - DNA, 20 bp, Artificial Sequence
  Description of Artificial Sequence: Synthetic oligonucleotide
  Target: ATXN1; (+) strand; PAM type: YTN; PAM sequence: TTA
gccgctgttctccttccgaa

SEQ ID NO: 299166 - DNA, 20 bp, Artificial Sequence
  Description of Artificial Sequence: Synthetic oligonucleotide
  Target: ATXN1; (+) strand; PAM type: YTN; PAM sequence: CTG
ttctccttccgaatgccccc

SEQ ID NO: 299167 - DNA, 20 bp, Artificial Sequence
  Description of Artificial Sequence: Synthetic oligonucleotide
  Target: ATXN1; (+) strand; PAM type: YTN; PAM sequence: TTC
tccttccgaatgcccccata

SEQ ID NO: 299168 - DNA, 20 bp, Artificial Sequence
  Description of Artificial Sequence: Synthetic oligonucleotide
  Target: ATXN1; (+) strand; PAM type: YTN; PAM sequence: CTC
cttccgaatgcccccatacc

SEQ ID NO: 299169 - DNA, 20 bp, Artificial Sequence
  Description of Artificial Sequence: Synthetic oligonucleotide
  Target: ATXN1; (+) strand; PAM type: YTN; PAM sequence: CTT
ccgaatgcccccatacctgc

SEQ ID NO: 299170 - DNA, 20 bp, Artificial Sequence
  Description of Artificial Sequence: Synthetic oligonucleotide
  Target: ATXN1; (+) strand; PAM type: YTN; PAM sequence: TTC
cgaatgcccccatacctgcc

SEQ ID NO: 299171 - DNA, 20 bp, Artificial Sequence
  Description of Artificial Sequence: Synthetic oligonucleotide
  Target: ATXN1; (+) strand; PAM type: YTN; PAM sequence: CTG
ccaacatctgtatctgaaca

SEQ ID NO: 299172 - DNA, 20 bp, Artificial Sequence
  Description of Artificial Sequence: Synthetic oligonucleotide
  Target: ATXN1; (+) strand; PAM type: YTN; PAM sequence: CTG
tatctgaacacactcaatgt

SEQ ID NO: 299173 - DNA, 20 bp, Artificial Sequence
  Description of Artificial Sequence: Synthetic oligonucleotide
  Target: ATXN1; (+) strand; PAM type: YTN; PAM sequence: CTG
aacacactcaatgttgggtc

SEQ ID NO: 299174 - DNA, 20 bp, Artificial Sequence
  Description of Artificial Sequence: Synthetic oligonucleotide
  Target: ATXN1; (+) strand; PAM type: YTN; PAM sequence: CTC
aatgttgggtccaacataag

SEQ ID NO: 299175 - DNA, 20 bp, Artificial Sequence
  Description of Artificial Sequence: Synthetic oligonucleotide
  Target: ATXN1; (+) strand; PAM type: YTN; PAM sequence: TTG
ggtccaacataaggaatttc

SEQ ID NO: 299176 - DNA, 20 bp, Artificial Sequence
  Description of Artificial Sequence: Synthetic oligonucleotide
  Target: ATXN1; (+) strand; PAM type: YTN; PAM sequence: TTT
cccttcttctttcttattaa

SEQ ID NO: 299177 - DNA, 20 bp, Artificial Sequence
  Description of Artificial Sequence: Synthetic oligonucleotide
  Target: ATXN1; (+) strand; PAM type: YTN; PAM sequence: TTC
ccttcttctttcttattaaa

SEQ ID NO: 299178 - DNA, 20 bp, Artificial Sequence
  Description of Artificial Sequence: Synthetic oligonucleotide
  Target: ATXN1; (+) strand; PAM type: YTN; PAM sequence: CTT
cttctttcttattaaagatt

SEQ ID NO: 299179 - DNA, 20 bp, Artificial Sequence
  Description of Artificial Sequence: Synthetic oligonucleotide
  Target: ATXN1; (+) strand; PAM type: YTN; PAM sequence: TTC
ttctttcttattaaagattc

SEQ ID NO: 299180 - DNA, 20 bp, Artificial Sequence
  Description of Artificial Sequence: Synthetic oligonucleotide
  Target: ATXN1; (+) strand; PAM type: YTN; PAM sequence: CTT
ctttcttattaaagattccc

SEQ ID NO: 299181 - DNA, 20 bp, Artificial Sequence
  Description of Artificial Sequence: Synthetic oligonucleotide
  Target: ATXN1; (+) strand; PAM type: YTN; PAM sequence: TTC
tttcttattaaagattccca

SEQ ID NO: 299182 - DNA, 20 bp, Artificial Sequence
  Description of Artificial Sequence: Synthetic oligonucleotide
  Target: ATXN1; (+) strand; PAM type: YTN; PAM sequence: CTT
tcttattaaagattcccagg

SEQ ID NO: 299183 - DNA, 20 bp, Artificial Sequence
  Description of Artificial Sequence: Synthetic oligonucleotide
  Target: ATXN1; (+) strand; PAM type: YTN; PAM sequence: TTT
cttattaaagattcccaggc

SEQ ID NO: 299184 - DNA, 20 bp, Artificial Sequence
  Description of Artificial Sequence: Synthetic oligonucleotide
  Target: ATXN1; (+) strand; PAM type: YTN; PAM sequence: TTC
ttattaaagattcccaggcc

SEQ ID NO: 299185 - DNA, 20 bp, Artificial Sequence
  Description of Artificial Sequence: Synthetic oligonucleotide
  Target: ATXN1; (+) strand; PAM type: YTN; PAM sequence: CTT
attaaagattcccaggcctc

SEQ ID NO: 299186 - DNA, 20 bp, Artificial Sequence
  Description of Artificial Sequence: Synthetic oligonucleotide
  Target: ATXN1; (+) strand; PAM type: YTN; PAM sequence: TTA
ttaaagattcccaggcctca

SEQ ID NO: 299187 - DNA, 20 bp, Artificial Sequence
  Description of Artificial Sequence: Synthetic oligonucleotide
  Target: ATXN1; (+) strand; PAM type: YTN; PAM sequence: TTA
aagattcccaggcctcagca

SEQ ID NO: 299188 - DNA, 20 bp, Artificial Sequence
  Description of Artificial Sequence: Synthetic oligonucleotide
  Target: ATXN1; (+) strand; PAM type: YTN; PAM sequence: TTC
ccaggcctcagcatcacccc

SEQ ID NO: 299189 - DNA, 20 bp, Artificial Sequence
  Description of Artificial Sequence: Synthetic oligonucleotide
  Target: ATXN1; (+) strand; PAM type: YTN; PAM sequence: CTC
agcatcaccccctacccaag

SEQ ID NO: 299190 - DNA, 20 bp, Artificial Sequence
  Description of Artificial Sequence: Synthetic oligonucleotide
  Target: ATXN1; (+) strand; PAM type: YTN; PAM sequence: CTA
cccaagcacttggataattc

SEQ ID NO: 299191 - DNA, 20 bp, Artificial Sequence
  Description of Artificial Sequence: Synthetic oligonucleotide
  Target: ATXN1; (+) strand; PAM type: YTN; PAM sequence: CTT
ggataattcagtagaggcca

SEQ ID NO: 299192 - DNA, 20 bp, Artificial Sequence
  Description of Artificial Sequence: Synthetic oligonucleotide
  Target: ATXN1; (+) strand; PAM type: YTN; PAM sequence: TTG
gataattcagtagaggccac

SEQ ID NO: 299193 - DNA, 20 bp, Artificial Sequence
  Description of Artificial Sequence: Synthetic oligonucleotide
  Target: ATXN1; (+) strand; PAM type: YTN; PAM sequence: TTC
agtagaggccactggggaga

SEQ ID NO: 299194 - DNA, 20 bp, Artificial Sequence
  Description of Artificial Sequence: Synthetic oligonucleotide
  Target: ATXN1; (+) strand; PAM type: YTN; PAM sequence: CTG
gggagaactttttttttttg

SEQ ID NO: 299195 - DNA, 20 bp, Artificial Sequence
  Description of Artificial Sequence: Synthetic oligonucleotide
  Target: ATXN1; (+) strand; PAM type: YTN; PAM sequence: CTT
tttttttttgagatggagtc

SEQ ID NO: 299196 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagatggagtct

SEQ ID NO: 299197 - DNA, 20 bp, Artificial Sequence
  Description of Artificial Sequence: Synthetic oligonucleotide
  Target: ATXN1; (+) strand; PAM type: YTN; PAM sequence: TTT
tttttttgagatggagtctc

SEQ ID NO: 299198 - DNA, 20 bp, Artificial Sequence
  Description of Artificial Sequence: Synthetic oligonucleotide
  Target: ATXN1; (+) strand; PAM type: YTN; PAM sequence: TTT
ttttttgagatggagtctca

SEQ ID NO: 299199 - DNA, 20 bp, Artificial Sequence
  Description of Artificial Sequence: Synthetic oligonucleotide
  Target: ATXN1; (+) strand; PAM type: YTN; PAM sequence: TTT
tttttgagatggagtctcac

SEQ ID NO: 299200 - DNA, 20 bp, Artificial Sequence
  Description of Artificial Sequence: Synthetic oligonucleotide
  Target: ATXN1; (+) strand; PAM type: YTN; PAM sequence: TTT
ttttgagatggagtctcact

SEQ ID NO: 299201 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtctcactc

SEQ ID NO: 299202 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtctcactct

SEQ ID NO: 299203 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtctcactctg

SEQ ID NO: 299204 - DNA, 20 bp, Artificial Sequence
  Description of Artificial Sequence: Synthetic oligonucleotide
  Target: ATXN1; (+) strand; PAM type: YTN; PAM sequence: TTT
gagatggagtctcactctgt

SEQ ID NO: 299205 - DNA, 20 bp, Artificial Sequence
  Description of Artificial Sequence: Synthetic oligonucleotide
  Target: ATXN1; (+) strand; PAM type: YTN; PAM sequence: TTG
agatggagtctcactctgtc

SEQ ID NO: 299206 - DNA, 20 bp, Artificial Sequence
  Description of Artificial Sequence: Synthetic oligonucleotide
  Target: ATXN1; (+) strand; PAM type: YTN; PAM sequence: CTC
actctgtcacccaggctgga

SEQ ID NO: 299207 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgc

SEQ ID NO: 299208 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgcag

SEQ ID NO: 299209 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtgatgcaatctc

SEQ ID NO: 299210 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaacctccacc

SEQ ID NO: 299211 - DNA, 20 bp, Artificial Sequence
  Description of Artificial Sequence: Synthetic oligonucleotide
  Target: ATXN1; (+) strand; PAM type: YTN; PAM sequence: CTC
actgcaacctccacctccca

SEQ ID NO: 299212 - DNA, 20 bp, Artificial Sequence
  Description of Artificial Sequence: Synthetic oligonucleotide
  Target: ATXN1; (+) strand; PAM type: YTN; PAM sequence: CTG
caacctccacctcccaggtt

SEQ ID NO: 299213 - DNA, 20 bp, Artificial Sequence
  Description of Artificial Sequence: Synthetic oligonucleotide
  Target: ATXN1; (+) strand; PAM type: YTN; PAM sequence: CTC
cacctcccaggttcaagtga

SEQ ID NO: 299214 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagtgattctcg

SEQ ID NO: 299215 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcgtgcctcag

SEQ ID NO: 299216 - DNA, 20 bp, Artificial Sequence
  Description of Artificial Sequence: Synthetic oligonucleotide
  Target: ATXN1; (+) strand; PAM type: YTN; PAM sequence: TTC
tcgtgcctcagcctcccaag

SEQ ID NO: 299217 - DNA, 20 bp, Artificial Sequence
  Description of Artificial Sequence: Synthetic oligonucleotide
  Target: ATXN1; (+) strand; PAM type: YTN; PAM sequence: CTC
gtgcctcagcctcccaagta

SEQ ID NO: 299218 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 299219 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 299220 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgcaccac

SEQ ID NO: 299221 - DNA, 20 bp, Artificial Sequence
  Description of Artificial Sequence: Synthetic oligonucleotide
  Target: ATXN1; (+) strand; PAM type: YTN; PAM sequence: TTA
caggtgtgcaccaccacacc

SEQ ID NO: 299222 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtaaa

SEQ ID NO: 299223 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtaaagatg

SEQ ID NO: 299224 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtaaagatgc

SEQ ID NO: 299225 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtaaagatgca

SEQ ID NO: 299226 - DNA, 20 bp, Artificial Sequence
  Description of Artificial Sequence: Synthetic oligonucleotide
  Target: ATXN1; (+) strand; PAM type: YTN; PAM sequence: TTG
tatttttagtaaagatgcag

SEQ ID NO: 299227 - DNA, 20 bp, Artificial Sequence
  Description of Artificial Sequence: Synthetic oligonucleotide
  Target: ATXN1; (+) strand; PAM type: YTN; PAM sequence: TTT
ttagtaaagatgcagtttca

SEQ ID NO: 299228 - DNA, 20 bp, Artificial Sequence
  Description of Artificial Sequence: Synthetic oligonucleotide
  Target: ATXN1; (+) strand; PAM type: YTN; PAM sequence: TTT
tagtaaagatgcagtttcac

SEQ ID NO: 299229 - DNA, 20 bp, Artificial Sequence
  Description of Artificial Sequence: Synthetic oligonucleotide
  Target: ATXN1; (+) strand; PAM type: YTN; PAM sequence: TTT
agtaaagatgcagtttcacc

SEQ ID NO: 299230 - DNA, 20 bp, Artificial Sequence
  Description of Artificial Sequence: Synthetic oligonucleotide
  Target: ATXN1; (+) strand; PAM type: YTN; PAM sequence: TTA
gtaaagatgcagtttcacca

SEQ ID NO: 299231 - DNA, 20 bp, Artificial Sequence
  Description of Artificial Sequence: Synthetic oligonucleotide
  Target: ATXN1; (+) strand; PAM type: YTN; PAM sequence: TTT
caccatgatggccaggcttg

SEQ ID NO: 299232 - DNA, 20 bp, Artificial Sequence
  Description of Artificial Sequence: Synthetic oligonucleotide
  Target: ATXN1; (+) strand; PAM type: YTN; PAM sequence: TTC
accatgatggccaggcttgt

SEQ ID NO: 299233 - DNA, 20 bp, Artificial Sequence
  Description of Artificial Sequence: Synthetic oligonucleotide
  Target: ATXN1; (+) strand; PAM type: YTN; PAM sequence: CTT
gtctcgaactcctgacctca

SEQ ID NO: 299234 - DNA, 20 bp, Artificial Sequence
  Description of Artificial Sequence: Synthetic oligonucleotide
  Target: ATXN1; (+) strand; PAM type: YTN; PAM sequence: TTG
tctcgaactcctgacctcag

SEQ ID NO: 299235 - DNA, 20 bp, Artificial Sequence
  Description of Artificial Sequence: Synthetic oligonucleotide
  Target: ATXN1; (+) strand; PAM type: YTN; PAM sequence: CTC
gaactcctgacctcaggtga

SEQ ID NO: 299236 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatctgtc

SEQ ID NO: 299237 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatctgtccgc

SEQ ID NO: 299238 - DNA, 20 bp, Artificial Sequence
  Description of Artificial Sequence: Synthetic oligonucleotide
  Target: ATXN1; (+) strand; PAM type: YTN; PAM sequence: CTC
aggtgatctgtccgcctcgg

SEQ ID NO: 299239 - DNA, 20 bp, Artificial Sequence
  Description of Artificial Sequence: Synthetic oligonucleotide
  Target: ATXN1; (+) strand; PAM type: YTN; PAM sequence: CTG
tccgcctcggcctcccaaag

SEQ ID NO: 299240 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 299241 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 299242 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgagccac

SEQ ID NO: 299243 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccaccgcgcc

SEQ ID NO: 299244 - DNA, 20 bp, Artificial Sequence
  Description of Artificial Sequence: Synthetic oligonucleotide
  Target: ATXN1; (+) strand; PAM type: YTN; PAM sequence: CTG
gcctctctggggttttctga

SEQ ID NO: 299245 - DNA, 20 bp, Artificial Sequence
  Description of Artificial Sequence: Synthetic oligonucleotide
  Target: ATXN1; (+) strand; PAM type: YTN; PAM sequence: CTC
tctggggttttctgaagcca

SEQ ID NO: 299246 - DNA, 20 bp, Artificial Sequence
  Description of Artificial Sequence: Synthetic oligonucleotide
  Target: ATXN1; (+) strand; PAM type: YTN; PAM sequence: CTC
tggggttttctgaagccaca

SEQ ID NO: 299247 - DNA, 20 bp, Artificial Sequence
  Description of Artificial Sequence: Synthetic oligonucleotide
  Target: ATXN1; (+) strand; PAM type: YTN; PAM sequence: CTG
gggttttctgaagccacata

SEQ ID NO: 299248 - DNA, 20 bp, Artificial Sequence
  Description of Artificial Sequence: Synthetic oligonucleotide
  Target: ATXN1; (+) strand; PAM type: YTN; PAM sequence: TTT
tctgaagccacatagactta

SEQ ID NO: 299249 - DNA, 20 bp, Artificial Sequence
  Description of Artificial Sequence: Synthetic oligonucleotide
  Target: ATXN1; (+) strand; PAM type: YTN; PAM sequence: TTT
ctgaagccacatagacttac

SEQ ID NO: 299250 - DNA, 20 bp, Artificial Sequence
  Description of Artificial Sequence: Synthetic oligonucleotide
  Target: ATXN1; (+) strand; PAM type: YTN; PAM sequence: TTC
tgaagccacatagacttaca

SEQ ID NO: 299251 - DNA, 20 bp, Artificial Sequence
  Description of Artificial Sequence: Synthetic oligonucleotide
  Target: ATXN1; (+) strand; PAM type: YTN; PAM sequence: CTG
aagccacatagacttacatg

SEQ ID NO: 299252 - DNA, 20 bp, Artificial Sequence
  Description of Artificial Sequence: Synthetic oligonucleotide
  Target: ATXN1; (+) strand; PAM type: YTN; PAM sequence: CTT
acatgtttgaggatttccca

SEQ ID NO: 299253 - DNA, 20 bp, Artificial Sequence
  Description of Artificial Sequence: Synthetic oligonucleotide
  Target: ATXN1; (+) strand; PAM type: YTN; PAM sequence: TTA
catgtttgaggatttcccat

SEQ ID NO: 299254 - DNA, 20 bp, Artificial Sequence
  Description of Artificial Sequence: Synthetic oligonucleotide
  Target: ATXN1; (+) strand; PAM type: YTN; PAM sequence: TTT
gaggatttcccattcaaagt

SEQ ID NO: 299255 - DNA, 20 bp, Artificial Sequence
  Description of Artificial Sequence: Synthetic oligonucleotide
  Target: ATXN1; (+) strand; PAM type: YTN; PAM sequence: TTG
aggatttcccattcaaagtc

SEQ ID NO: 299256 - DNA, 20 bp, Artificial Sequence
  Description of Artificial Sequence: Synthetic oligonucleotide
  Target: ATXN1; (+) strand; PAM type: YTN; PAM sequence: TTT
cccattcaaagtcctaaaga

SEQ ID NO: 299257 - DNA, 20 bp, Artificial Sequence
  Description of Artificial Sequence: Synthetic oligonucleotide
  Target: ATXN1; (+) strand; PAM type: YTN; PAM sequence: TTC
ccattcaaagtcctaaagaa

SEQ ID NO: 299258 - DNA, 20 bp, Artificial Sequence
  Description of Artificial Sequence: Synthetic oligonucleotide
  Target: ATXN1; (+) strand; PAM type: YTN; PAM sequence: TTC
aaagtcctaaagaacactaa

SEQ ID NO: 299259 - DNA, 20 bp, Artificial Sequence
  Description of Artificial Sequence: Synthetic oligonucleotide
  Target: ATXN1; (+) strand; PAM type: YTN; PAM sequence: CTA
aagaacactaatagaagaaa

SEQ ID NO: 299260 - DNA, 20 bp, Artificial Sequence
  Description of Artificial Sequence: Synthetic oligonucleotide
  Target: ATXN1; (+) strand; PAM type: YTN; PAM sequence: CTA
atagaagaaaaagaaaggaa

SEQ ID NO: 299261 - DNA, 20 bp, Artificial Sequence
  Description of Artificial Sequence: Synthetic oligonucleotide
  Target: ATXN1; (+) strand; PAM type: YTN; PAM sequence: TTT
aatttatcaggacccttagt

SEQ ID NO: 299262 - DNA, 20 bp, Artificial Sequence
  Description of Artificial Sequence: Synthetic oligonucleotide
  Target: ATXN1; (+) strand; PAM type: YTN; PAM sequence: TTA
atttatcaggacccttagtc

SEQ ID NO: 299263 - DNA, 20 bp, Artificial Sequence
  Description of Artificial Sequence: Synthetic oligonucleotide
  Target: ATXN1; (+) strand; PAM type: YTN; PAM sequence: TTT
atcaggacccttagtcacat

SEQ ID NO: 299264 - DNA, 20 bp, Artificial Sequence
  Description of Artificial Sequence: Synthetic oligonucleotide
  Target: ATXN1; (+) strand; PAM type: YTN; PAM sequence: TTA
tcaggacccttagtcacatt

SEQ ID NO: 299265 - DNA, 20 bp, Artificial Sequence
  Description of Artificial Sequence: Synthetic oligonucleotide
  Target: ATXN1; (+) strand; PAM type: YTN; PAM sequence: CTT
agtcacattcacatacattg

SEQ ID NO: 299266 - DNA, 20 bp, Artificial Sequence
  Description of Artificial Sequence: Synthetic oligonucleotide
  Target: ATXN1; (+) strand; PAM type: YTN; PAM sequence: TTA
gtcacattcacatacattgc

SEQ ID NO: 299267 - DNA, 20 bp, Artificial Sequence
  Description of Artificial Sequence: Synthetic oligonucleotide
  Target: ATXN1; (+) strand; PAM type: YTN; PAM sequence: TTC
acatacattgcccatgataa

SEQ ID NO: 299268 - DNA, 20 bp, Artificial Sequence
  Description of Artificial Sequence: Synthetic oligonucleotide
  Target: ATXN1; (+) strand; PAM type: YTN; PAM sequence: TTG
cccatgataagccagtgaca

SEQ ID NO: 299269 - DNA, 20 bp, Artificial Sequence
  Description of Artificial Sequence: Synthetic oligonucleotide
  Target: ATXN1; (+) strand; PAM type: YTN; PAM sequence: TTG
aagttttaaagtacatgtgc

SEQ ID NO: 299270 - DNA, 20 bp, Artificial Sequence
  Description of Artificial Sequence: Synthetic oligonucleotide
  Target: ATXN1; (+) strand; PAM type: YTN; PAM sequence: TTT
taaagtacatgtgcaaggga

SEQ ID NO: 299271 - DNA, 20 bp, Artificial Sequence
  Description of Artificial Sequence: Synthetic oligonucleotide
  Target: ATXN1; (+) strand; PAM type: YTN; PAM sequence: TTT
aaagtacatgtgcaagggat

SEQ ID NO: 299272 - DNA, 20 bp, Artificial Sequence
  Description of Artificial Sequence: Synthetic oligonucleotide
  Target: ATXN1; (+) strand; PAM type: YTN; PAM sequence: TTA
aagtacatgtgcaagggatc

SEQ ID NO: 299273 - DNA, 20 bp, Artificial Sequence
  Description of Artificial Sequence: Synthetic oligonucleotide
  Target: ATXN1; (+) strand; PAM type: YTN; PAM sequence: CTA
cttgaaacctcccagcagga

SEQ ID NO: 299274 - DNA, 20 bp, Artificial Sequence
  Description of Artificial Sequence: Synthetic oligonucleotide
  Target: ATXN1; (+) strand; PAM type: YTN; PAM sequence: CTT
gaaacctcccagcaggaaaa

SEQ ID NO: 299275 - DNA, 20 bp, Artificial Sequence
  Description of Artificial Sequence: Synthetic oligonucleotide
  Target: ATXN1; (+) strand; PAM type: YTN; PAM sequence: TTG
aaacctcccagcaggaaaac

SEQ ID NO: 299276 - DNA, 20 bp, Artificial Sequence
  Description of Artificial Sequence: Synthetic oligonucleotide
  Target: ATXN1; (+) strand; PAM type: YTN; PAM sequence: CTC
ccagcaggaaaacaagaaat

SEQ ID NO: 299277 - DNA, 20 bp, Artificial Sequence
  Description of Artificial Sequence: Synthetic oligonucleotide
  Target: ATXN1; (+) strand; PAM type: YTN; PAM sequence: CTC
cacatttactgtacaagtaa

SEQ ID NO: 299278 - DNA, 20 bp, Artificial Sequence
  Description of Artificial Sequence: Synthetic oligonucleotide
  Target: ATXN1; (+) strand; PAM type: YTN; PAM sequence: TTT
actgtacaagtaataacata

SEQ ID NO: 299279 - DNA, 20 bp, Artificial Sequence
  Description of Artificial Sequence: Synthetic oligonucleotide
  Target: ATXN1; (+) strand; PAM type: YTN; PAM sequence: TTA
ctgtacaagtaataacataa

SEQ ID NO: 299280 - DNA, 20 bp, Artificial Sequence
  Description of Artificial Sequence: Synthetic oligonucleotide
  Target: ATXN1; (+) strand; PAM type: YTN; PAM sequence: CTG
tacaagtaataacataagca

SEQ ID NO: 299281 - DNA, 20 bp, Artificial Sequence
  Description of Artificial Sequence: Synthetic oligonucleotide
  Target: ATXN1; (+) strand; PAM type: YTN; PAM sequence: CTT
cctaagagtgttttatagta

SEQ ID NO: 299282 - DNA, 20 bp, Artificial Sequence
  Description of Artificial Sequence: Synthetic oligonucleotide
  Target: ATXN1; (+) strand; PAM type: YTN; PAM sequence: TTC
ctaagagtgttttatagtat

SEQ ID NO: 299283 - DNA, 20 bp, Artificial Sequence
  Description of Artificial Sequence: Synthetic oligonucleotide
  Target: ATXN1; (+) strand; PAM type: YTN; PAM sequence: CTA
agagtgttttatagtatttt

SEQ ID NO: 299284 - DNA, 20 bp, Artificial Sequence
  Description of Artificial Sequence: Synthetic oligonucleotide
  Target: ATXN1; (+) strand; PAM type: YTN; PAM sequence: TTT
tatagtattttacatggcaa

SEQ ID NO: 299285 - DNA, 20 bp, Artificial Sequence
  Description of Artificial Sequence: Synthetic oligonucleotide
  Target: ATXN1; (+) strand; PAM type: YTN; PAM sequence: TTT
atagtattttacatggcaag

SEQ ID NO: 299286 - DNA, 20 bp, Artificial Sequence
  Description of Artificial Sequence: Synthetic oligonucleotide
  Target: ATXN1; (+) strand; PAM type: YTN; PAM sequence: TTA
tagtattttacatggcaaga

SEQ ID NO: 299287 - DNA, 20 bp, Artificial Sequence
  Description of Artificial Sequence: Synthetic oligonucleotide
  Target: ATXN1; (+) strand; PAM type: YTN; PAM sequence: TTT
tacatggcaagactcttact

SEQ ID NO: 299288 - DNA, 20 bp, Artificial Sequence
  Description of Artificial Sequence: Synthetic oligonucleotide
  Target: ATXN1; (+) strand; PAM type: YTN; PAM sequence: TTT
acatggcaagactcttactc

SEQ ID NO: 299289 - DNA, 20 bp, Artificial Sequence
  Description of Artificial Sequence: Synthetic oligonucleotide
  Target: ATXN1; (+) strand; PAM type: YTN; PAM sequence: TTA
catggcaagactcttactct

SEQ ID NO: 299290 - DNA, 20 bp, Artificial Sequence
  Description of Artificial Sequence: Synthetic oligonucleotide
  Target: ATXN1; (+) strand; PAM type: YTN; PAM sequence: CTC
ttactctccagtctgttaat

SEQ ID NO: 299291 - DNA, 20 bp, Artificial Sequence
  Description of Artificial Sequence: Synthetic oligonucleotide
  Target: ATXN1; (+) strand; PAM type: YTN; PAM sequence: CTT
actctccagtctgttaatcc

SEQ ID NO: 299292 - DNA, 20 bp, Artificial Sequence
  Description of Artificial Sequence: Synthetic oligonucleotide
  Target: ATXN1; (+) strand; PAM type: YTN; PAM sequence: TTA
ctctccagtctgttaatcct

SEQ ID NO: 299293 - DNA, 20 bp, Artificial Sequence
  Description of Artificial Sequence: Synthetic oligonucleotide
  Target: ATXN1; (+) strand; PAM type: YTN; PAM sequence: CTC
tccagtctgttaatcctcac

SEQ ID NO: 299294 - DNA, 20 bp, Artificial Sequence
  Description of Artificial Sequence: Synthetic oligonucleotide
  Target: ATXN1; (+) strand; PAM type: YTN; PAM sequence: CTC
cagtctgttaatcctcactt

SEQ ID NO: 299295 - DNA, 20 bp, Artificial Sequence
  Description of Artificial Sequence: Synthetic oligonucleotide
  Target: ATXN1; (+) strand; PAM type: YTN; PAM sequence: CTG
ttaatcctcactttcccgct

SEQ ID NO: 299296 - DNA, 20 bp, Artificial Sequence
  Description of Artificial Sequence: Synthetic oligonucleotide
  Target: ATXN1; (+) strand; PAM type: YTN; PAM sequence: TTA
atcctcactttcccgcttct

SEQ ID NO: 299297 - DNA, 20 bp, Artificial Sequence
  Description of Artificial Sequence: Synthetic oligonucleotide
  Target: ATXN1; (+) strand; PAM type: YTN; PAM sequence: CTC
actttcccgcttctattcat

SEQ ID NO: 299298 - DNA, 20 bp, Artificial Sequence
  Description of Artificial Sequence: Synthetic oligonucleotide
  Target: ATXN1; (+) strand; PAM type: YTN; PAM sequence: CTT
tcccgcttctattcatatgc

SEQ ID NO: 299299 - DNA, 20 bp, Artificial Sequence
  Description of Artificial Sequence: Synthetic oligonucleotide
  Target: ATXN1; (+) strand; PAM type: YTN; PAM sequence: TTT
cccgcttctattcatatgct

SEQ ID NO: 299300 - DNA, 20 bp, Artificial Sequence
  Description of Artificial Sequence: Synthetic oligonucleotide
  Target: ATXN1; (+) strand; PAM type: YTN; PAM sequence: TTC
ccgcttctattcatatgctt

SEQ ID NO: 299301 - DNA, 20 bp, Artificial Sequence
  Description of Artificial Sequence: Synthetic oligonucleotide
  Target: ATXN1; (+) strand; PAM type: YTN; PAM sequence: CTT
ctattcatatgctttatatg

SEQ ID NO: 299302 - DNA, 20 bp, Artificial Sequence
  Description of Artificial Sequence: Synthetic oligonucleotide
  Target: ATXN1; (+) strand; PAM type: YTN; PAM sequence: TTC
tattcatatgctttatatgt

SEQ ID NO: 299303 - DNA, 20 bp, Artificial Sequence
  Description of Artificial Sequence: Synthetic oligonucleotide
  Target: ATXN1; (+) strand; PAM type: YTN; PAM sequence: CTA
ttcatatgctttatatgtat

SEQ ID NO: 299304 - DNA, 20 bp, Artificial Sequence
  Description of Artificial Sequence: Synthetic oligonucleotide
  Target: ATXN1; (+) strand; PAM type: YTN; PAM sequence: TTC
atatgctttatatgtattta

SEQ ID NO: 299305 - DNA, 20 bp, Artificial Sequence
  Description of Artificial Sequence: Synthetic oligonucleotide
  Target: ATXN1; (+) strand; PAM type: YTN; PAM sequence: CTT
tatatgtatttatttgttga

SEQ ID NO: 299306 - DNA, 20 bp, Artificial Sequence
  Description of Artificial Sequence: Synthetic oligonucleotide
  Target: ATXN1; (+) strand; PAM type: YTN; PAM sequence: TTT
atatgtatttatttgttgag

SEQ ID NO: 299307 - DNA, 20 bp, Artificial Sequence
  Description of Artificial Sequence: Synthetic oligonucleotide
  Target: ATXN1; (+) strand; PAM type: YTN; PAM sequence: TTA
tatgtatttatttgttgagt

SEQ ID NO: 299308 - DNA, 20 bp, Artificial Sequence
  Description of Artificial Sequence: Synthetic oligonucleotide
  Target: ATXN1; (+) strand; PAM type: YTN; PAM sequence: TTT
atttgttgagttatatattt

SEQ ID NO: 299309 - DNA, 20 bp, Artificial Sequence
  Description of Artificial Sequence: Synthetic oligonucleotide
  Target: ATXN1; (+) strand; PAM type: YTN; PAM sequence: TTA
tttgttgagttatatatttt

SEQ ID NO: 299310 - DNA, 20 bp, Artificial Sequence
  Description of Artificial Sequence: Synthetic oligonucleotide
  Target: ATXN1; (+) strand; PAM type: YTN; PAM sequence: TTT
gttgagttatatattttagc

SEQ ID NO: 299311 - DNA, 20 bp, Artificial Sequence
  Description of Artificial Sequence: Synthetic oligonucleotide
  Target: ATXN1; (+) strand; PAM type: YTN; PAM sequence: TTG
ttgagttatatattttagct

SEQ ID NO: 299312 - DNA, 20 bp, Artificial Sequence
  Description of Artificial Sequence: Synthetic oligonucleotide
  Target: ATXN1; (+) strand; PAM type: YTN; PAM sequence: TTG
agttatatattttagctgaa

SEQ ID NO: 299313 - DNA, 20 bp, Artificial Sequence
  Description of Artificial Sequence: Synthetic oligonucleotide
  Target: ATXN1; (+) strand; PAM type: YTN; PAM sequence: TTA
tatattttagctgaacttgg

SEQ ID NO: 299314 - DNA, 20 bp, Artificial Sequence
  Description of Artificial Sequence: Synthetic oligonucleotide
  Target: ATXN1; (+) strand; PAM type: YTN; PAM sequence: TTT
tagctgaacttggaatgaca

SEQ ID NO: 299315 - DNA, 20 bp, Artificial Sequence
  Description of Artificial Sequence: Synthetic oligonucleotide
  Target: ATXN1; (+) strand; PAM type: YTN; PAM sequence: TTT
agctgaacttggaatgacag

SEQ ID NO: 299316 - DNA, 20 bp, Artificial Sequence
  Description of Artificial Sequence: Synthetic oligonucleotide
  Target: ATXN1; (+) strand; PAM type: YTN; PAM sequence: TTA
gctgaacttggaatgacagt

SEQ ID NO: 299317 - DNA, 20 bp, Artificial Sequence
  Description of Artificial Sequence: Synthetic oligonucleotide
  Target: ATXN1; (+) strand; PAM type: YTN; PAM sequence: CTG
aacttggaatgacagttatt

SEQ ID NO: 299318 - DNA, 20 bp, Artificial Sequence
  Description of Artificial Sequence: Synthetic oligonucleotide
  Target: ATXN1; (+) strand; PAM type: YTN; PAM sequence: CTT
ggaatgacagttatttttaa

SEQ ID NO: 299319 - DNA, 20 bp, Artificial Sequence
  Description of Artificial Sequence: Synthetic oligonucleotide
  Target: ATXN1; (+) strand; PAM type: YTN; PAM sequence: TTG
gaatgacagttatttttaag

SEQ ID NO: 299320 - DNA, 20 bp, Artificial Sequence
  Description of Artificial Sequence: Synthetic oligonucleotide
  Target: ATXN1; (+) strand; PAM type: YTN; PAM sequence: TTA
tttttaagaggctaccaaca

SEQ ID NO: 299321 - DNA, 20 bp, Artificial Sequence
  Description of Artificial Sequence: Synthetic oligonucleotide
  Target: ATXN1; (+) strand; PAM type: YTN; PAM sequence: TTT
ttaagaggctaccaacatgg

SEQ ID NO: 299322 - DNA, 20 bp, Artificial Sequence
  Description of Artificial Sequence: Synthetic oligonucleotide
  Target: ATXN1; (+) strand; PAM type: YTN; PAM sequence: TTT
taagaggctaccaacatggg

SEQ ID NO: 299323 - DNA, 20 bp, Artificial Sequence
  Description of Artificial Sequence: Synthetic oligonucleotide
  Target: ATXN1; (+) strand; PAM type: YTN; PAM sequence: TTT
aagaggctaccaacatgggt

SEQ ID NO: 299324 - DNA, 20 bp, Artificial Sequence
  Description of Artificial Sequence: Synthetic oligonucleotide
  Target: ATXN1; (+) strand; PAM type: YTN; PAM sequence: TTA
agaggctaccaacatgggtc

SEQ ID NO: 299325 - DNA, 20 bp, Artificial Sequence
  Description of Artificial Sequence: Synthetic oligonucleotide
  Target: ATXN1; (+) strand; PAM type: YTN; PAM sequence: CTA
ccaacatgggtcaggaagaa

SEQ ID NO: 299326 - DNA, 20 bp, Artificial Sequence
  Description of Artificial Sequence: Synthetic oligonucleotide
  Target: ATXN1; (+) strand; PAM type: YTN; PAM sequence: CTC
agaaacctggctcacagttg

SEQ ID NO: 299327 - DNA, 20 bp, Artificial Sequence
  Description of Artificial Sequence: Synthetic oligonucleotide
  Target: ATXN1; (+) strand; PAM type: YTN; PAM sequence: CTG
gctcacagttgctctggcat

SEQ ID NO: 299328 - DNA, 20 bp, Artificial Sequence
  Description of Artificial Sequence: Synthetic oligonucleotide
  Target: ATXN1; (+) strand; PAM type: YTN; PAM sequence: CTC
acagttgctctggcataaaa

SEQ ID NO: 299329 - DNA, 20 bp, Artificial Sequence
  Description of Artificial Sequence: Synthetic oligonucleotide
  Target: ATXN1; (+) strand; PAM type: YTN; PAM sequence: TTG
ctctggcataaaaagccttg

SEQ ID NO: 299330 - DNA, 20 bp, Artificial Sequence
  Description of Artificial Sequence: Synthetic oligonucleotide
  Target: ATXN1; (+) strand; PAM type: YTN; PAM sequence: CTC
tggcataaaaagccttgacc

SEQ ID NO: 299331 - DNA, 20 bp, Artificial Sequence
  Description of Artificial Sequence: Synthetic oligonucleotide
  Target: ATXN1; (+) strand; PAM type: YTN; PAM sequence: CTG
gcataaaaagccttgaccgc

SEQ ID NO: 299332 - DNA, 20 bp, Artificial Sequence
  Description of Artificial Sequence: Synthetic oligonucleotide
  Target: ATXN1; (+) strand; PAM type: YTN; PAM sequence: CTT
gaccgccaaaaccaaccagg

SEQ ID NO: 299333 - DNA, 20 bp, Artificial Sequence
  Description of Artificial Sequence: Synthetic oligonucleotide
  Target: ATXN1; (+) strand; PAM type: YTN; PAM sequence: TTG
accgccaaaaccaaccaggg

SEQ ID NO: 299334 - DNA, 20 bp, Artificial Sequence
  Description of Artificial Sequence: Synthetic oligonucleotide
  Target: ATXN1; (+) strand; PAM type: YTN; PAM sequence: TTG
atgagatctaggtttccaaa

SEQ ID NO: 299335 - DNA, 20 bp, Artificial Sequence
  Description of Artificial Sequence: Synthetic oligonucleotide
  Target: ATXN1; (+) strand; PAM type: YTN; PAM sequence: CTA
ggtttccaaaacaccacgaa

SEQ ID NO: 299336 - DNA, 20 bp, Artificial Sequence
  Description of Artificial Sequence: Synthetic oligonucleotide
  Target: ATXN1; (+) strand; PAM type: YTN; PAM sequence: TTT
ccaaaacaccacgaaaaggc

SEQ ID NO: 299337 - DNA, 20 bp, Artificial Sequence
  Description of Artificial Sequence: Synthetic oligonucleotide
  Target: ATXN1; (+) strand; PAM type: YTN; PAM sequence: TTC
caaaacaccacgaaaaggca

SEQ ID NO: 299338 - DNA, 20 bp, Artificial Sequence
  Description of Artificial Sequence: Synthetic oligonucleotide
  Target: ATXN1; (+) strand; PAM type: YTN; PAM sequence: CTT
ttgctttctcccatctggcc

SEQ ID NO: 299339 - DNA, 20 bp, Artificial Sequence
  Description of Artificial Sequence: Synthetic oligonucleotide
  Target: ATXN1; (+) strand; PAM type: YTN; PAM sequence: TTT
tgctttctcccatctggcca

SEQ ID NO: 299340 - DNA, 20 bp, Artificial Sequence
  Description of Artificial Sequence: Synthetic oligonucleotide
  Target: ATXN1; (+) strand; PAM type: YTN; PAM sequence: TTT
gctttctcccatctggccat

SEQ ID NO: 299341 - DNA, 20 bp, Artificial Sequence
  Description of Artificial Sequence: Synthetic oligonucleotide
  Target: ATXN1; (+) strand; PAM type: YTN; PAM sequence: TTG
ctttctcccatctggccatt

SEQ ID NO: 299342 - DNA, 20 bp, Artificial Sequence
  Description of Artificial Sequence: Synthetic oligonucleotide
  Target: ATXN1; (+) strand; PAM type: YTN; PAM sequence: CTT
tctcccatctggccattaaa

SEQ ID NO: 299343 - DNA, 20 bp, Artificial Sequence
  Description of Artificial Sequence: Synthetic oligonucleotide
  Target: ATXN1; (+) strand; PAM type: YTN; PAM sequence: TTT
ctcccatctggccattaaaa

SEQ ID NO: 299344 - DNA, 20 bp, Artificial Sequence
  Description of Artificial Sequence: Synthetic oligonucleotide
  Target: ATXN1; (+) strand; PAM type: YTN; PAM sequence: TTC
tcccatctggccattaaaaa

SEQ ID NO: 299345 - DNA, 20 bp, Artificial Sequence
  Description of Artificial Sequence: Synthetic oligonucleotide
  Target: ATXN1; (+) strand; PAM type: YTN; PAM sequence: CTC
ccatctggccattaaaaaaa

SEQ ID NO: 299346 - DNA, 20 bp, Artificial Sequence
  Description of Artificial Sequence: Synthetic oligonucleotide
  Target: ATXN1; (+) strand; PAM type: YTN; PAM sequence: CTG
gccattaaaaaaaaaaatag

SEQ ID NO: 299347 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaatagttattta

SEQ ID NO: 299348 - DNA, 20 bp, Artificial Sequence
  Description of Artificial Sequence: Synthetic oligonucleotide
  Target: ATXN1; (+) strand; PAM type: YTN; PAM sequence: TTA
tttaccaaagaagattcttt

SEQ ID NO: 299349 - DNA, 20 bp, Artificial Sequence
  Description of Artificial Sequence: Synthetic oligonucleotide
  Target: ATXN1; (+) strand; PAM type: YTN; PAM sequence: TTT
accaaagaagattctttttg

SEQ ID NO: 299350 - DNA, 20 bp, Artificial Sequence
  Description of Artificial Sequence: Synthetic oligonucleotide
  Target: ATXN1; (+) strand; PAM type: YTN; PAM sequence: TTA
ccaaagaagattctttttgt

SEQ ID NO: 299351 - DNA, 20 bp, Artificial Sequence
  Description of Artificial Sequence: Synthetic oligonucleotide
  Target: ATXN1; (+) strand; PAM type: YTN; PAM sequence: TTC
tttttgtaatacaatcaatc

SEQ ID NO: 299352 - DNA, 20 bp, Artificial Sequence
  Description of Artificial Sequence: Synthetic oligonucleotide
  Target: ATXN1; (+) strand; PAM type: YTN; PAM sequence: CTT
tttgtaatacaatcaatcac

SEQ ID NO: 299353 - DNA, 20 bp, Artificial Sequence
  Description of Artificial Sequence: Synthetic oligonucleotide
  Target: ATXN1; (+) strand; PAM type: YTN; PAM sequence: TTT
ttgtaatacaatcaatcact

SEQ ID NO: 299354 - DNA, 20 bp, Artificial Sequence
  Description of Artificial Sequence: Synthetic oligonucleotide
  Target: ATXN1; (+) strand; PAM type: YTN; PAM sequence: TTT
tgtaatacaatcaatcactt

SEQ ID NO: 299355 - DNA, 20 bp, Artificial Sequence
  Description of Artificial Sequence: Synthetic oligonucleotide
  Target: ATXN1; (+) strand; PAM type: YTN; PAM sequence: TTT
gtaatacaatcaatcacttc

SEQ ID NO: 299356 - DNA, 20 bp, Artificial Sequence
  Description of Artificial Sequence: Synthetic oligonucleotide
  Target: ATXN1; (+) strand; PAM type: YTN; PAM sequence: TTG
taatacaatcaatcacttcc

SEQ ID NO: 299357 - DNA, 20 bp, Artificial Sequence
  Description of Artificial Sequence: Synthetic oligonucleotide
  Target: ATXN1; (+) strand; PAM type: YTN; PAM sequence: CTT
cctcctgtgtttagggttca

SEQ ID NO: 299358 - DNA, 20 bp, Artificial Sequence
  Description of Artificial Sequence: Synthetic oligonucleotide
  Target: ATXN1; (+) strand; PAM type: YTN; PAM sequence: TTC
ctcctgtgtttagggttcaa

SEQ ID NO: 299359 - DNA, 20 bp, Artificial Sequence
  Description of Artificial Sequence: Synthetic oligonucleotide
  Target: ATXN1; (+) strand; PAM type: YTN; PAM sequence: CTC
ctgtgtttagggttcaaatc

SEQ ID NO: 299360 - DNA, 20 bp, Artificial Sequence
  Description of Artificial Sequence: Synthetic oligonucleotide
  Target: ATXN1; (+) strand; PAM type: YTN; PAM sequence: CTG
tgtttagggttcaaatctag

SEQ ID NO: 299361 - DNA, 20 bp, Artificial Sequence
  Description of Artificial Sequence: Synthetic oligonucleotide
  Target: ATXN1; (+) strand; PAM type: YTN; PAM sequence: TTT
agggttcaaatctagaagtc

SEQ ID NO: 299362 - DNA, 20 bp, Artificial Sequence
  Description of Artificial Sequence: Synthetic oligonucleotide
  Target: ATXN1; (+) strand; PAM type: YTN; PAM sequence: TTA
gggttcaaatctagaagtcc

SEQ ID NO: 299363 - DNA, 20 bp, Artificial Sequence
  Description of Artificial Sequence: Synthetic oligonucleotide
  Target: ATXN1; (+) strand; PAM type: YTN; PAM sequence: TTC
aaatctagaagtccatatgt

SEQ ID NO: 299364 - DNA, 20 bp, Artificial Sequence
  Description of Artificial Sequence: Synthetic oligonucleotide
  Target: ATXN1; (+) strand; PAM type: YTN; PAM sequence: CTA
gaagtccatatgtcagtcta

SEQ ID NO: 299365 - DNA, 20 bp, Artificial Sequence
  Description of Artificial Sequence: Synthetic oligonucleotide
  Target: ATXN1; (+) strand; PAM type: YTN; PAM sequence: CTA
gcttagagcaaaatgtagct

SEQ ID NO: 299366 - DNA, 20 bp, Artificial Sequence
  Description of Artificial Sequence: Synthetic oligonucleotide
  Target: ATXN1; (+) strand; PAM type: YTN; PAM sequence: CTT
agagcaaaatgtagctttct

SEQ ID NO: 299367 - DNA, 20 bp, Artificial Sequence
  Description of Artificial Sequence: Synthetic oligonucleotide
  Target: ATXN1; (+) strand; PAM type: YTN; PAM sequence: TTA
gagcaaaatgtagctttctt

SEQ ID NO: 299368 - DNA, 20 bp, Artificial Sequence
  Description of Artificial Sequence: Synthetic oligonucleotide
  Target: ATXN1; (+) strand; PAM type: YTN; PAM sequence: CTT
tcttcaccttggactagaac

SEQ ID NO: 299369 - DNA, 20 bp, Artificial Sequence
  Description of Artificial Sequence: Synthetic oligonucleotide
  Target: ATXN1; (+) strand; PAM type: YTN; PAM sequence: TTT
cttcaccttggactagaaca

SEQ ID NO: 299370 - DNA, 20 bp, Artificial Sequence
  Description of Artificial Sequence: Synthetic oligonucleotide
  Target: ATXN1; (+) strand; PAM type: YTN; PAM sequence: TTC
ttcaccttggactagaacaa

SEQ ID NO: 299371 - DNA, 20 bp, Artificial Sequence
  Description of Artificial Sequence: Synthetic oligonucleotide
  Target: ATXN1; (+) strand; PAM type: YTN; PAM sequence: CTT
caccttggactagaacaacc

SEQ ID NO: 299372 - DNA, 20 bp, Artificial Sequence
  Description of Artificial Sequence: Synthetic oligonucleotide
  Target: ATXN1; (+) strand; PAM type: YTN; PAM sequence: TTC
accttggactagaacaacct

SEQ ID NO: 299373 - DNA, 20 bp, Artificial Sequence
  Description of Artificial Sequence: Synthetic oligonucleotide
  Target: ATXN1; (+) strand; PAM type: YTN; PAM sequence: CTT
ggactagaacaacctatgag

SEQ ID NO: 299374 - DNA, 20 bp, Artificial Sequence
  Description of Artificial Sequence: Synthetic oligonucleotide
  Target: ATXN1; (+) strand; PAM type: YTN; PAM sequence: TTG
gactagaacaacctatgaga

SEQ ID NO: 299375 - DNA, 20 bp, Artificial Sequence
  Description of Artificial Sequence: Synthetic oligonucleotide
  Target: ATXN1; (+) strand; PAM type: YTN; PAM sequence: CTA
gaacaacctatgagagaaag

SEQ ID NO: 299376 - DNA, 20 bp, Artificial Sequence
  Description of Artificial Sequence: Synthetic oligonucleotide
  Target: ATXN1; (+) strand; PAM type: YTN; PAM sequence: CTA
tgagagaaagatggtgccca

SEQ ID NO: 299377 - DNA, 20 bp, Artificial Sequence
  Description of Artificial Sequence: Synthetic oligonucleotide
  Target: ATXN1; (+) strand; PAM type: YTN; PAM sequence: CTG
ctttctaaattgacagccct

SEQ ID NO: 299378 - DNA, 20 bp, Artificial Sequence
  Description of Artificial Sequence: Synthetic oligonucleotide
  Target: ATXN1; (+) strand; PAM type: YTN; PAM sequence: CTT
tctaaattgacagccctgag

SEQ ID NO: 299379 - DNA, 20 bp, Artificial Sequence
  Description of Artificial Sequence: Synthetic oligonucleotide
  Target: ATXN1; (+) strand; PAM type: YTN; PAM sequence: TTT
ctaaattgacagccctgagc

SEQ ID NO: 299380 - DNA, 20 bp, Artificial Sequence
  Description of Artificial Sequence: Synthetic oligonucleotide
  Target: ATXN1; (+) strand; PAM type: YTN; PAM sequence: TTC
taaattgacagccctgagct

SEQ ID NO: 299381 - DNA, 20 bp, Artificial Sequence
  Description of Artificial Sequence: Synthetic oligonucleotide
  Target: ATXN1; (+) strand; PAM type: YTN; PAM sequence: CTA
aattgacagccctgagcttc

SEQ ID NO: 299382 - DNA, 20 bp, Artificial Sequence
  Description of Artificial Sequence: Synthetic oligonucleotide
  Target: ATXN1; (+) strand; PAM type: YTN; PAM sequence: TTG
acagccctgagcttctccat

SEQ ID NO: 299383 - DNA, 20 bp, Artificial Sequence
  Description of Artificial Sequence: Synthetic oligonucleotide
  Target: ATXN1; (+) strand; PAM type: YTN; PAM sequence: CTG
agcttctccatggacagtgt

SEQ ID NO: 299384 - DNA, 20 bp, Artificial Sequence
  Description of Artificial Sequence: Synthetic oligonucleotide
  Target: ATXN1; (+) strand; PAM type: YTN; PAM sequence: CTT
ctccatggacagtgttccaa

SEQ ID NO: 299385 - DNA, 20 bp, Artificial Sequence
  Description of Artificial Sequence: Synthetic oligonucleotide
  Target: ATXN1; (+) strand; PAM type: YTN; PAM sequence: TTC
tccatggacagtgttccaaa

SEQ ID NO: 299386 - DNA, 20 bp, Artificial Sequence
  Description of Artificial Sequence: Synthetic oligonucleotide
  Target: ATXN1; (+) strand; PAM type: YTN; PAM sequence: CTC
catggacagtgttccaaaac

SEQ ID NO: 299387 - DNA, 20 bp, Artificial Sequence
  Description of Artificial Sequence: Synthetic oligonucleotide
  Target: ATXN1; (+) strand; PAM type: YTN; PAM sequence: TTC
caaaactaactgtggctgtt

SEQ ID NO: 299388 - DNA, 20 bp, Artificial Sequence
  Description of Artificial Sequence: Synthetic oligonucleotide
  Target: ATXN1; (+) strand; PAM type: YTN; PAM sequence: CTA
actgtggctgttaggataaa

SEQ ID NO: 299389 - DNA, 20 bp, Artificial Sequence
  Description of Artificial Sequence: Synthetic oligonucleotide
  Target: ATXN1; (+) strand; PAM type: YTN; PAM sequence: CTG
tggctgttaggataaagagg

SEQ ID NO: 299390 - DNA, 20 bp, Artificial Sequence
  Description of Artificial Sequence: Synthetic oligonucleotide
  Target: ATXN1; (+) strand; PAM type: YTN; PAM sequence: CTG
ttaggataaagagggcagtt

SEQ ID NO: 299391 - DNA, 20 bp, Artificial Sequence
  Description of Artificial Sequence: Synthetic oligonucleotide
  Target: ATXN1; (+) strand; PAM type: YTN; PAM sequence: TTA
ggataaagagggcagtttct

SEQ ID NO: 299392 - DNA, 20 bp, Artificial Sequence
  Description of Artificial Sequence: Synthetic oligonucleotide
  Target: ATXN1; (+) strand; PAM type: YTN; PAM sequence: TTT
ctcagcttcagtgcctttaa

SEQ ID NO: 299393 - DNA, 20 bp, Artificial Sequence
  Description of Artificial Sequence: Synthetic oligonucleotide
  Target: ATXN1; (+) strand; PAM type: YTN; PAM sequence: TTC
tcagcttcagtgcctttaag

SEQ ID NO: 299394 - DNA, 20 bp, Artificial Sequence
  Description of Artificial Sequence: Synthetic oligonucleotide
  Target: ATXN1; (+) strand; PAM type: YTN; PAM sequence: CTC
agcttcagtgcctttaaggt

SEQ ID NO: 299395 - DNA, 20 bp, Artificial Sequence
  Description of Artificial Sequence: Synthetic oligonucleotide
  Target: ATXN1; (+) strand; PAM type: YTN; PAM sequence: CTT
cagtgcctttaaggttattt

SEQ ID NO: 299396 - DNA, 20 bp, Artificial Sequence
  Description of Artificial Sequence: Synthetic oligonucleotide
  Target: ATXN1; (+) strand; PAM type: YTN; PAM sequence: TTC
agtgcctttaaggttatttc

SEQ ID NO: 299397 - DNA, 20 bp, Artificial Sequence
  Description of Artificial Sequence: Synthetic oligonucleotide
  Target: ATXN1; (+) strand; PAM type: YTN; PAM sequence: CTT
taaggttatttcaactttcc

SEQ ID NO: 299398 - DNA, 20 bp, Artificial Sequence
  Description of Artificial Sequence: Synthetic oligonucleotide
  Target: ATXN1; (+) strand; PAM type: YTN; PAM sequence: TTT
aaggttatttcaactttcca

SEQ ID NO: 299399 - DNA, 20 bp, Artificial Sequence
  Description of Artificial Sequence: Synthetic oligonucleotide
  Target: ATXN1; (+) strand; PAM type: YTN; PAM sequence: TTA
aggttatttcaactttccac

SEQ ID NO: 299400 - DNA, 20 bp, Artificial Sequence
  Description of Artificial Sequence: Synthetic oligonucleotide
  Target: ATXN1; (+) strand; PAM type: YTN; PAM sequence: TTA
tttcaactttccacctctgt

SEQ ID NO: 299401 - DNA, 20 bp, Artificial Sequence
  Description of Artificial Sequence: Synthetic oligonucleotide
  Target: ATXN1; (+) strand; PAM type: YTN; PAM sequence: TTT
caactttccacctctgttaa

SEQ ID NO: 299402 - DNA, 20 bp, Artificial Sequence
  Description of Artificial Sequence: Synthetic oligonucleotide
  Target: ATXN1; (+) strand; PAM type: YTN; PAM sequence: TTC
aactttccacctctgttaac

SEQ ID NO: 299403 - DNA, 20 bp, Artificial Sequence
  Description of Artificial Sequence: Synthetic oligonucleotide
  Target: ATXN1; (+) strand; PAM type: YTN; PAM sequence: CTT
tccacctctgttaactacgc

SEQ ID NO: 299404 - DNA, 20 bp, Artificial Sequence
  Description of Artificial Sequence: Synthetic oligonucleotide
  Target: ATXN1; (+) strand; PAM type: YTN; PAM sequence: TTT
ccacctctgttaactacgct

SEQ ID NO: 299405 - DNA, 20 bp, Artificial Sequence
  Description of Artificial Sequence: Synthetic oligonucleotide
  Target: ATXN1; (+) strand; PAM type: YTN; PAM sequence: TTC
cacctctgttaactacgctg

SEQ ID NO: 299406 - DNA, 20 bp, Artificial Sequence
  Description of Artificial Sequence: Synthetic oligonucleotide
  Target: ATXN1; (+) strand; PAM type: YTN; PAM sequence: CTC
tgttaactacgctgcagaaa

SEQ ID NO: 299407 - DNA, 20 bp, Artificial Sequence
  Description of Artificial Sequence: Synthetic oligonucleotide
  Target: ATXN1; (+) strand; PAM type: YTN; PAM sequence: CTG
ttaactacgctgcagaaact

SEQ ID NO: 299408 - DNA, 20 bp, Artificial Sequence
  Description of Artificial Sequence: Synthetic oligonucleotide
  Target: ATXN1; (+) strand; PAM type: YTN; PAM sequence: TTA
actacgctgcagaaactttt

SEQ ID NO: 299409 - DNA, 20 bp, Artificial Sequence
  Description of Artificial Sequence: Synthetic oligonucleotide
  Target: ATXN1; (+) strand; PAM type: YTN; PAM sequence: CTA
cgctgcagaaacttttgaca

SEQ ID NO: 299410 - DNA, 20 bp, Artificial Sequence
  Description of Artificial Sequence: Synthetic oligonucleotide
  Target: ATXN1; (+) strand; PAM type: YTN; PAM sequence: CTG
cagaaacttttgacactgaa

SEQ ID NO: 299411 - DNA, 20 bp, Artificial Sequence
  Description of Artificial Sequence: Synthetic oligonucleotide
  Target: ATXN1; (+) strand; PAM type: YTN; PAM sequence: CTT
ttgacactgaactctcctta

SEQ ID NO: 299412 - DNA, 20 bp, Artificial Sequence
  Description of Artificial Sequence: Synthetic oligonucleotide
  Target: ATXN1; (+) strand; PAM type: YTN; PAM sequence: TTT
tgacactgaactctccttaa

SEQ ID NO: 299413 - DNA, 20 bp, Artificial Sequence
  Description of Artificial Sequence: Synthetic oligonucleotide
  Target: ATXN1; (+) strand; PAM type: YTN; PAM sequence: TTT
gacactgaactctccttaat

SEQ ID NO: 299414 - DNA, 20 bp, Artificial Sequence
  Description of Artificial Sequence: Synthetic oligonucleotide
  Target: ATXN1; (+) strand; PAM type: YTN; PAM sequence: TTG
acactgaactctccttaata

SEQ ID NO: 299415 - DNA, 20 bp, Artificial Sequence
  Description of Artificial Sequence: Synthetic oligonucleotide
  Target: ATXN1; (+) strand; PAM type: YTN; PAM sequence: CTG
aactctccttaatatccata

SEQ ID NO: 299416 - DNA, 20 bp, Artificial Sequence
  Description of Artificial Sequence: Synthetic oligonucleotide
  Target: ATXN1; (+) strand; PAM type: YTN; PAM sequence: CTC
tccttaatatccataagcca

SEQ ID NO: 299417 - DNA, 20 bp, Artificial Sequence
  Description of Artificial Sequence: Synthetic oligonucleotide
  Target: ATXN1; (+) strand; PAM type: YTN; PAM sequence: CTC
cttaatatccataagccaga

SEQ ID NO: 299418 - DNA, 20 bp, Artificial Sequence
  Description of Artificial Sequence: Synthetic oligonucleotide
  Target: ATXN1; (+) strand; PAM type: YTN; PAM sequence: CTT
aatatccataagccagagat

SEQ ID NO: 299419 - DNA, 20 bp, Artificial Sequence
  Description of Artificial Sequence: Synthetic oligonucleotide
  Target: ATXN1; (+) strand; PAM type: YTN; PAM sequence: TTA
atatccataagccagagatg

SEQ ID NO: 299420 - DNA, 20 bp, Artificial Sequence
  Description of Artificial Sequence: Synthetic oligonucleotide
  Target: ATXN1; (+) strand; PAM type: YTN; PAM sequence: TTC
attagaaaaatttctcactc

SEQ ID NO: 299421 - DNA, 20 bp, Artificial Sequence
  Description of Artificial Sequence: Synthetic oligonucleotide
  Target: ATXN1; (+) strand; PAM type: YTN; PAM sequence: TTA
gaaaaatttctcactcctca

SEQ ID NO: 299422 - DNA, 20 bp, Artificial Sequence
  Description of Artificial Sequence: Synthetic oligonucleotide
  Target: ATXN1; (+) strand; PAM type: YTN; PAM sequence: TTT
ctcactcctcatcagacagc

SEQ ID NO: 299423 - DNA, 20 bp, Artificial Sequence
  Description of Artificial Sequence: Synthetic oligonucleotide
  Target: ATXN1; (+) strand; PAM type: YTN; PAM sequence: TTC
tcactcctcatcagacagct

SEQ ID NO: 299424 - DNA, 20 bp, Artificial Sequence
  Description of Artificial Sequence: Synthetic oligonucleotide
  Target: ATXN1; (+) strand; PAM type: YTN; PAM sequence: CTC
actcctcatcagacagctga

SEQ ID NO: 299425 - DNA, 20 bp, Artificial Sequence
  Description of Artificial Sequence: Synthetic oligonucleotide
  Target: ATXN1; (+) strand; PAM type: YTN; PAM sequence: CTC
ctcatcagacagctgaagac

SEQ ID NO: 299426 - DNA, 20 bp, Artificial Sequence
  Description of Artificial Sequence: Synthetic oligonucleotide
  Target: ATXN1; (+) strand; PAM type: YTN; PAM sequence: CTC
atcagacagctgaagacctg

SEQ ID NO: 299427 - DNA, 20 bp, Artificial Sequence
  Description of Artificial Sequence: Synthetic oligonucleotide
  Target: ATXN1; (+) strand; PAM type: YTN; PAM sequence: CTG
aagacctgagtcctttgtct

SEQ ID NO: 299428 - DNA, 20 bp, Artificial Sequence
  Description of Artificial Sequence: Synthetic oligonucleotide
  Target: ATXN1; (+) strand; PAM type: YTN; PAM sequence: CTG
agtcctttgtcttcccctat

SEQ ID NO: 299429 - DNA, 20 bp, Artificial Sequence
  Description of Artificial Sequence: Synthetic oligonucleotide
  Target: ATXN1; (+) strand; PAM type: YTN; PAM sequence: CTT
tgtcttcccctattctggag

SEQ ID NO: 299430 - DNA, 20 bp, Artificial Sequence
  Description of Artificial Sequence: Synthetic oligonucleotide
  Target: ATXN1; (+) strand; PAM type: YTN; PAM sequence: TTT
gtcttcccctattctggaga

SEQ ID NO: 299431 - DNA, 20 bp, Artificial Sequence
  Description of Artificial Sequence: Synthetic oligonucleotide
  Target: ATXN1; (+) strand; PAM type: YTN; PAM sequence: TTG
tcttcccctattctggagat

SEQ ID NO: 299432 - DNA, 20 bp, Artificial Sequence
  Description of Artificial Sequence: Synthetic oligonucleotide
  Target: ATXN1; (+) strand; PAM type: YTN; PAM sequence: CTT
cccctattctggagatcaca

SEQ ID NO: 299433 - DNA, 20 bp, Artificial Sequence
  Description of Artificial Sequence: Synthetic oligonucleotide
  Target: ATXN1; (+) strand; PAM type: YTN; PAM sequence: TTC
ccctattctggagatcacat

SEQ ID NO: 299434 - DNA, 20 bp, Artificial Sequence
  Description of Artificial Sequence: Synthetic oligonucleotide
  Target: ATXN1; (+) strand; PAM type: YTN; PAM sequence: CTA
ttctggagatcacattgaag

SEQ ID NO: 299435 - DNA, 20 bp, Artificial Sequence
  Description of Artificial Sequence: Synthetic oligonucleotide
  Target: ATXN1; (+) strand; PAM type: YTN; PAM sequence: TTC
tggagatcacattgaaggga

SEQ ID NO: 299436 - DNA, 20 bp, Artificial Sequence
  Description of Artificial Sequence: Synthetic oligonucleotide
  Target: ATXN1; (+) strand; PAM type: YTN; PAM sequence: CTG
gagatcacattgaagggatt

SEQ ID NO: 299437 - DNA, 20 bp, Artificial Sequence
  Description of Artificial Sequence: Synthetic oligonucleotide
  Target: ATXN1; (+) strand; PAM type: YTN; PAM sequence: TTG
aagggatttttgggctacct

SEQ ID NO: 299438 - DNA, 20 bp, Artificial Sequence
  Description of Artificial Sequence: Synthetic oligonucleotide
  Target: ATXN1; (+) strand; PAM type: YTN; PAM sequence: TTT
ttgggctacctgaaagtgtt

SEQ ID NO: 299439 - DNA, 20 bp, Artificial Sequence
  Description of Artificial Sequence: Synthetic oligonucleotide
  Target: ATXN1; (+) strand; PAM type: YTN; PAM sequence: TTT
tgggctacctgaaagtgttt

SEQ ID NO: 299440 - DNA, 20 bp, Artificial Sequence
  Description of Artificial Sequence: Synthetic oligonucleotide
  Target: ATXN1; (+) strand; PAM type: YTN; PAM sequence: TTT
gggctacctgaaagtgttta

SEQ ID NO: 299441 - DNA, 20 bp, Artificial Sequence
  Description of Artificial Sequence: Synthetic oligonucleotide
  Target: ATXN1; (+) strand; PAM type: YTN; PAM sequence: TTG
ggctacctgaaagtgtttat

SEQ ID NO: 299442 - DNA, 20 bp, Artificial Sequence
  Description of Artificial Sequence: Synthetic oligonucleotide
  Target: ATXN1; (+) strand; PAM type: YTN; PAM sequence: CTA
cctgaaagtgtttatgacag

SEQ ID NO: 299443 - DNA, 20 bp, Artificial Sequence
  Description of Artificial Sequence: Synthetic oligonucleotide
  Target: ATXN1; (+) strand; PAM type: YTN; PAM sequence: CTG
aaagtgtttatgacagacag

SEQ ID NO: 299444 - DNA, 20 bp, Artificial Sequence
  Description of Artificial Sequence: Synthetic oligonucleotide
  Target: ATXN1; (+) strand; PAM type: YTN; PAM sequence: TTT
atgacagacagactcttgga

SEQ ID NO: 299445 - DNA, 20 bp, Artificial Sequence
  Description of Artificial Sequence: Synthetic oligonucleotide
  Target: ATXN1; (+) strand; PAM type: YTN; PAM sequence: TTA
tgacagacagactcttggat

SEQ ID NO: 299446 - DNA, 20 bp, Artificial Sequence
  Description of Artificial Sequence: Synthetic oligonucleotide
  Target: ATXN1; (+) strand; PAM type: YTN; PAM sequence: CTC
ttggattcaggcttaggaca

SEQ ID NO: 299447 - DNA, 20 bp, Artificial Sequence
  Description of Artificial Sequence: Synthetic oligonucleotide
  Target: ATXN1; (+) strand; PAM type: YTN; PAM sequence: CTT
ggattcaggcttaggacaag

SEQ ID NO: 299448 - DNA, 20 bp, Artificial Sequence
  Description of Artificial Sequence: Synthetic oligonucleotide
  Target: ATXN1; (+) strand; PAM type: YTN; PAM sequence: TTG
gattcaggcttaggacaagc

SEQ ID NO: 299449 - DNA, 20 bp, Artificial Sequence
  Description of Artificial Sequence: Synthetic oligonucleotide
  Target: ATXN1; (+) strand; PAM type: YTN; PAM sequence: TTC
aggcttaggacaagcaaacc

SEQ ID NO: 299450 - DNA, 20 bp, Artificial Sequence
  Description of Artificial Sequence: Synthetic oligonucleotide
  Target: ATXN1; (+) strand; PAM type: YTN; PAM sequence: CTT
aggacaagcaaacctttcat

SEQ ID NO: 299451 - DNA, 20 bp, Artificial Sequence
  Description of Artificial Sequence: Synthetic oligonucleotide
  Target: ATXN1; (+) strand; PAM type: YTN; PAM sequence: TTA
ggacaagcaaacctttcata

SEQ ID NO: 299452 - DNA, 20 bp, Artificial Sequence
  Description of Artificial Sequence: Synthetic oligonucleotide
  Target: ATXN1; (+) strand; PAM type: YTN; PAM sequence: CTT
tcatatgagtccttaaaaac

SEQ ID NO: 299453 - DNA, 20 bp, Artificial Sequence
  Description of Artificial Sequence: Synthetic oligonucleotide
  Target: ATXN1; (+) strand; PAM type: YTN; PAM sequence: TTT
catatgagtccttaaaaaca

SEQ ID NO: 299454 - DNA, 20 bp, Artificial Sequence
  Description of Artificial Sequence: Synthetic oligonucleotide
  Target: ATXN1; (+) strand; PAM type: YTN; PAM sequence: TTC
atatgagtccttaaaaacag

SEQ ID NO: 299455 - DNA, 20 bp, Artificial Sequence
  Description of Artificial Sequence: Synthetic oligonucleotide
  Target: ATXN1; (+) strand; PAM type: YTN; PAM sequence: CTT
aaaaacagacagtgctctgt

SEQ ID NO: 299456 - DNA, 20 bp, Artificial Sequence
  Description of Artificial Sequence: Synthetic oligonucleotide
  Target: ATXN1; (+) strand; PAM type: YTN; PAM sequence: TTA
aaaacagacagtgctctgtt

SEQ ID NO: 299457 - DNA, 20 bp, Artificial Sequence
  Description of Artificial Sequence: Synthetic oligonucleotide
  Target: ATXN1; (+) strand; PAM type: YTN; PAM sequence: CTC
tgtttgtaactttgaactcc

SEQ ID NO: 299458 - DNA, 20 bp, Artificial Sequence
  Description of Artificial Sequence: Synthetic oligonucleotide
  Target: ATXN1; (+) strand; PAM type: YTN; PAM sequence: CTG
tttgtaactttgaactccat

SEQ ID NO: 299459 - DNA, 20 bp, Artificial Sequence
  Description of Artificial Sequence: Synthetic oligonucleotide
  Target: ATXN1; (+) strand; PAM type: YTN; PAM sequence: TTT
gtaactttgaactccattct

SEQ ID NO: 299460 - DNA, 20 bp, Artificial Sequence
  Description of Artificial Sequence: Synthetic oligonucleotide
  Target: ATXN1; (+) strand; PAM type: YTN; PAM sequence: TTG
taactttgaactccattcta

SEQ ID NO: 299461 - DNA, 20 bp, Artificial Sequence
  Description of Artificial Sequence: Synthetic oligonucleotide
  Target: ATXN1; (+) strand; PAM type: YTN; PAM sequence: CTT
tgaactccattctagtacaa

SEQ ID NO: 299462 - DNA, 20 bp, Artificial Sequence
  Description of Artificial Sequence: Synthetic oligonucleotide
  Target: ATXN1; (+) strand; PAM type: YTN; PAM sequence: TTT
gaactccattctagtacaaa

SEQ ID NO: 299463 - DNA, 20 bp, Artificial Sequence
  Description of Artificial Sequence: Synthetic oligonucleotide
  Target: ATXN1; (+) strand; PAM type: YTN; PAM sequence: TTG
aactccattctagtacaaac

SEQ ID NO: 299464 - DNA, 20 bp, Artificial Sequence
  Description of Artificial Sequence: Synthetic oligonucleotide
  Target: ATXN1; (+) strand; PAM type: YTN; PAM sequence: CTC
cattctagtacaaacatgct

SEQ ID NO: 299465 - DNA, 20 bp, Artificial Sequence
  Description of Artificial Sequence: Synthetic oligonucleotide
  Target: ATXN1; (+) strand; PAM type: YTN; PAM sequence: TTC
tagtacaaacatgcttggca

SEQ ID NO: 299466 - DNA, 20 bp, Artificial Sequence
  Description of Artificial Sequence: Synthetic oligonucleotide
  Target: ATXN1; (+) strand; PAM type: YTN; PAM sequence: CTA
gtacaaacatgcttggcaac

SEQ ID NO: 299467 - DNA, 20 bp, Artificial Sequence
  Description of Artificial Sequence: Synthetic oligonucleotide
  Target: ATXN1; (+) strand; PAM type: YTN; PAM sequence: CTT
ggcaactagtgccggagggt

SEQ ID NO: 299468 - DNA, 20 bp, Artificial Sequence
  Description of Artificial Sequence: Synthetic oligonucleotide
  Target: ATXN1; (+) strand; PAM type: YTN; PAM sequence: TTG
gcaactagtgccggagggtt

SEQ ID NO: 299469 - DNA, 20 bp, Artificial Sequence
  Description of Artificial Sequence: Synthetic oligonucleotide
  Target: ATXN1; (+) strand; PAM type: YTN; PAM sequence: CTA
gtgccggagggttaaccaga

SEQ ID NO: 299470 - DNA, 20 bp, Artificial Sequence
  Description of Artificial Sequence: Synthetic oligonucleotide
  Target: ATXN1; (+) strand; PAM type: YTN; PAM sequence: TTA
accagagagttttcttcctg

SEQ ID NO: 299471 - DNA, 20 bp, Artificial Sequence
  Description of Artificial Sequence: Synthetic oligonucleotide
  Target: ATXN1; (+) strand; PAM type: YTN; PAM sequence: TTT
tcttcctggcaaattgctct

SEQ ID NO: 299472 - DNA, 20 bp, Artificial Sequence
  Description of Artificial Sequence: Synthetic oligonucleotide
  Target: ATXN1; (+) strand; PAM type: YTN; PAM sequence: TTT
cttcctggcaaattgctctg

SEQ ID NO: 299473 - DNA, 20 bp, Artificial Sequence
  Description of Artificial Sequence: Synthetic oligonucleotide
  Target: ATXN1; (+) strand; PAM type: YTN; PAM sequence: TTC
ttcctggcaaattgctctgc

SEQ ID NO: 299474 - DNA, 20 bp, Artificial Sequence
  Description of Artificial Sequence: Synthetic oligonucleotide
  Target: ATXN1; (+) strand; PAM type: YTN; PAM sequence: CTT
cctggcaaattgctctgccg

SEQ ID NO: 299475 - DNA, 20 bp, Artificial Sequence
  Description of Artificial Sequence: Synthetic oligonucleotide
  Target: ATXN1; (+) strand; PAM type: YTN; PAM sequence: TTC
ctggcaaattgctctgccgc

SEQ ID NO: 299476 - DNA, 20 bp, Artificial Sequence
  Description of Artificial Sequence: Synthetic oligonucleotide
  Target: ATXN1; (+) strand; PAM type: YTN; PAM sequence: CTG
gcaaattgctctgccgccac

SEQ ID NO: 299477 - DNA, 20 bp, Artificial Sequence
  Description of Artificial Sequence: Synthetic oligonucleotide
  Target: ATXN1; (+) strand; PAM type: YTN; PAM sequence: TTG
ctctgccgccaccatgggta

SEQ ID NO: 299478 - DNA, 20 bp, Artificial Sequence
  Description of Artificial Sequence: Synthetic oligonucleotide
  Target: ATXN1; (+) strand; PAM type: YTN; PAM sequence: CTC
tgccgccaccatgggtatta

SEQ ID NO: 299479 - DNA, 20 bp, Artificial Sequence
  Description of Artificial Sequence: Synthetic oligonucleotide
  Target: ATXN1; (+) strand; PAM type: YTN; PAM sequence: CTG
ccgccaccatgggtattaac

SEQ ID NO: 299480 - DNA, 20 bp, Artificial Sequence
  Description of Artificial Sequence: Synthetic oligonucleotide
  Target: ATXN1; (+) strand; PAM type: YTN; PAM sequence: TTA
acactccaggatccctgcaa

SEQ ID NO: 299481 - DNA, 20 bp, Artificial Sequence
  Description of Artificial Sequence: Synthetic oligonucleotide
  Target: ATXN1; (+) strand; PAM type: YTN; PAM sequence: CTC
caggatccctgcaactttcc

SEQ ID NO: 299482 - DNA, 20 bp, Artificial Sequence
  Description of Artificial Sequence: Synthetic oligonucleotide
  Target: ATXN1; (+) strand; PAM type: YTN; PAM sequence: CTG
caactttcccttcttcctct

SEQ ID NO: 299483 - DNA, 20 bp, Artificial Sequence
  Description of Artificial Sequence: Synthetic oligonucleotide
  Target: ATXN1; (+) strand; PAM type: YTN; PAM sequence: CTT
tcccttcttcctctattcct

SEQ ID NO: 299484 - DNA, 20 bp, Artificial Sequence
  Description of Artificial Sequence: Synthetic oligonucleotide
  Target: ATXN1; (+) strand; PAM type: YTN; PAM sequence: TTT
cccttcttcctctattcctc

SEQ ID NO: 299485 - DNA, 20 bp, Artificial Sequence
  Description of Artificial Sequence: Synthetic oligonucleotide
  Target: ATXN1; (+) strand; PAM type: YTN; PAM sequence: TTC
ccttcttcctctattcctca

SEQ ID NO: 299486 - DNA, 20 bp, Artificial Sequence
  Description of Artificial Sequence: Synthetic oligonucleotide
  Target: ATXN1; (+) strand; PAM type: YTN; PAM sequence: CTT
cttcctctattcctcatccc

SEQ ID NO: 299487 - DNA, 20 bp, Artificial Sequence
  Description of Artificial Sequence: Synthetic oligonucleotide
  Target: ATXN1; (+) strand; PAM type: YTN; PAM sequence: TTC
ttcctctattcctcatcccc

SEQ ID NO: 299488 - DNA, 20 bp, Artificial Sequence
  Description of Artificial Sequence: Synthetic oligonucleotide
  Target: ATXN1; (+) strand; PAM type: YTN; PAM sequence: CTT
cctctattcctcatcccctg

SEQ ID NO: 299489 - DNA, 20 bp, Artificial Sequence
  Description of Artificial Sequence: Synthetic oligonucleotide
  Target: ATXN1; (+) strand; PAM type: YTN; PAM sequence: TTC
ctctattcctcatcccctgc

SEQ ID NO: 299490 - DNA, 20 bp, Artificial Sequence
  Description of Artificial Sequence: Synthetic oligonucleotide
  Target: ATXN1; (+) strand; PAM type: YTN; PAM sequence: CTC
tattcctcatcccctgccct

SEQ ID NO: 299491 - DNA, 20 bp, Artificial Sequence
  Description of Artificial Sequence: Synthetic oligonucleotide
  Target: ATXN1; (+) strand; PAM type: YTN; PAM sequence: CTA
ttcctcatcccctgccctga

SEQ ID NO: 299492 - DNA, 20 bp, Artificial Sequence
  Description of Artificial Sequence: Synthetic oligonucleotide
  Target: ATXN1; (+) strand; PAM type: YTN; PAM sequence: TTC
ctcatcccctgccctgagat

SEQ ID NO: 299493 - DNA, 20 bp, Artificial Sequence
  Description of Artificial Sequence: Synthetic oligonucleotide
  Target: ATXN1; (+) strand; PAM type: YTN; PAM sequence: CTC
atcccctgccctgagatatt

SEQ ID NO: 299494 - DNA, 20 bp, Artificial Sequence
  Description of Artificial Sequence: Synthetic oligonucleotide
  Target: ATXN1; (+) strand; PAM type: YTN; PAM sequence: CTG
ccctgagatattatctgtgc

SEQ ID NO: 299495 - DNA, 20 bp, Artificial Sequence
  Description of Artificial Sequence: Synthetic oligonucleotide
  Target: ATXN1; (+) strand; PAM type: YTN; PAM sequence: CTG
agatattatctgtgcccaag

SEQ ID NO: 299496 - DNA, 20 bp, Artificial Sequence
  Description of Artificial Sequence: Synthetic oligonucleotide
  Target: ATXN1; (+) strand; PAM type: YTN; PAM sequence: TTA
tctgtgcccaagctgcaggg

SEQ ID NO: 299497 - DNA, 20 bp, Artificial Sequence
  Description of Artificial Sequence: Synthetic oligonucleotide
  Target: ATXN1; (+) strand; PAM type: YTN; PAM sequence: CTG
tgcccaagctgcaggggttg

SEQ ID NO: 299498 - DNA, 20 bp, Artificial Sequence
  Description of Artificial Sequence: Synthetic oligonucleotide
  Target: ATXN1; (+) strand; PAM type: YTN; PAM sequence: CTG
caggggttgaggtcacacat

SEQ ID NO: 299499 - DNA, 20 bp, Artificial Sequence
  Description of Artificial Sequence: Synthetic oligonucleotide
  Target: ATXN1; (+) strand; PAM type: YTN; PAM sequence: TTG
aggtcacacatctggtgcca

SEQ ID NO: 299500 - DNA, 20 bp, Artificial Sequence
  Description of Artificial Sequence: Synthetic oligonucleotide
  Target: ATXN1; (+) strand; PAM type: YTN; PAM sequence: CTG
gtgccaaggagctgtcagtg

SEQ ID NO: 299501 - DNA, 20 bp, Artificial Sequence
  Description of Artificial Sequence: Synthetic oligonucleotide
  Target: ATXN1; (+) strand; PAM type: YTN; PAM sequence: CTG
tcagtgcctccagcagtggc

SEQ ID NO: 299502 - DNA, 20 bp, Artificial Sequence
  Description of Artificial Sequence: Synthetic oligonucleotide
  Target: ATXN1; (+) strand; PAM type: YTN; PAM sequence: CTC
cagcagtggcacagttcatg

SEQ ID NO: 299503 - DNA, 20 bp, Artificial Sequence
  Description of Artificial Sequence: Synthetic oligonucleotide
  Target: ATXN1; (+) strand; PAM type: YTN; PAM sequence: TTC
atggttcacggttcttctcc

SEQ ID NO: 299504 - DNA, 20 bp, Artificial Sequence
  Description of Artificial Sequence: Synthetic oligonucleotide
  Target: ATXN1; (+) strand; PAM type: YTN; PAM sequence: TTC
acggttcttctcctggcccc

SEQ ID NO: 299505 - DNA, 20 bp, Artificial Sequence
  Description of Artificial Sequence: Synthetic oligonucleotide
  Target: ATXN1; (+) strand; PAM type: YTN; PAM sequence: TTC
ttctcctggcccctcccttg

SEQ ID NO: 299506 - DNA, 20 bp, Artificial Sequence
  Description of Artificial Sequence: Synthetic oligonucleotide
  Target: ATXN1; (+) strand; PAM type: YTN; PAM sequence: CTT
ctcctggcccctcccttggt

SEQ ID NO: 299507 - DNA, 20 bp, Artificial Sequence
  Description of Artificial Sequence: Synthetic oligonucleotide
  Target: ATXN1; (+) strand; PAM type: YTN; PAM sequence: TTC
tcctggcccctcccttggtc

SEQ ID NO: 299508 - DNA, 20 bp, Artificial Sequence
  Description of Artificial Sequence: Synthetic oligonucleotide
  Target: ATXN1; (+) strand; PAM type: YTN; PAM sequence: CTC
ctggcccctcccttggtctg

SEQ ID NO: 299509 - DNA, 20 bp, Artificial Sequence
  Description of Artificial Sequence: Synthetic oligonucleotide
  Target: ATXN1; (+) strand; PAM type: YTN; PAM sequence: CTG
gcccctcccttggtctggca

SEQ ID NO: 299510 - DNA, 20 bp, Artificial Sequence
  Description of Artificial Sequence: Synthetic oligonucleotide
  Target: ATXN1; (+) strand; PAM type: YTN; PAM sequence: CTC
ccttggtctggcatgctgac

SEQ ID NO: 299511 - DNA, 20 bp, Artificial Sequence
  Description of Artificial Sequence: Synthetic oligonucleotide
  Target: ATXN1; (+) strand; PAM type: YTN; PAM sequence: CTT
ggtctggcatgctgacagaa

SEQ ID NO: 299512 - DNA, 20 bp, Artificial Sequence
  Description of Artificial Sequence: Synthetic oligonucleotide
  Target: ATXN1; (+) strand; PAM type: YTN; PAM sequence: TTG
gtctggcatgctgacagaaa

SEQ ID NO: 299513 - DNA, 20 bp, Artificial Sequence
  Description of Artificial Sequence: Synthetic oligonucleotide
  Target: ATXN1; (+) strand; PAM type: YTN; PAM sequence: CTG
gcatgctgacagaaaattgt

SEQ ID NO: 299514 - DNA, 20 bp, Artificial Sequence
  Description of Artificial Sequence: Synthetic oligonucleotide
  Target: ATXN1; (+) strand; PAM type: YTN; PAM sequence: CTG
acagaaaattgttctttttt

SEQ ID NO: 299515 - DNA, 20 bp, Artificial Sequence
  Description of Artificial Sequence: Synthetic oligonucleotide
  Target: ATXN1; (+) strand; PAM type: YTN; PAM sequence: TTG
ttctttttttcatcatttgt

SEQ ID NO: 299516 - DNA, 20 bp, Artificial Sequence
  Description of Artificial Sequence: Synthetic oligonucleotide
  Target: ATXN1; (+) strand; PAM type: YTN; PAM sequence: TTC
tttttttcatcatttgtctg

SEQ ID NO: 299517 - DNA, 20 bp, Artificial Sequence
  Description of Artificial Sequence: Synthetic oligonucleotide
  Target: ATXN1; (+) strand; PAM type: YTN; PAM sequence: CTT
tttttcatcatttgtctgtg

SEQ ID NO: 299518 - DNA, 20 bp, Artificial Sequence
  Description of Artificial Sequence: Synthetic oligonucleotide
  Target: ATXN1; (+) strand; PAM type: YTN; PAM sequence: TTT
ttttcatcatttgtctgtga

SEQ ID NO: 299519 - DNA, 20 bp, Artificial Sequence
  Description of Artificial Sequence: Synthetic oligonucleotide
  Target: ATXN1; (+) strand; PAM type: YTN; PAM sequence: TTT
tttcatcatttgtctgtgac

SEQ ID NO: 299520 - DNA, 20 bp, Artificial Sequence
  Description of Artificial Sequence: Synthetic oligonucleotide
  Target: ATXN1; (+) strand; PAM type: YTN; PAM sequence: TTT
ttcatcatttgtctgtgact

SEQ ID NO: 299521 - DNA, 20 bp, Artificial Sequence
  Description of Artificial Sequence: Synthetic oligonucleotide
  Target: ATXN1; (+) strand; PAM type: YTN; PAM sequence: TTT
tcatcatttgtctgtgactc

SEQ ID NO: 299522 - DNA, 20 bp, Artificial Sequence
  Description of Artificial Sequence: Synthetic oligonucleotide
  Target: ATXN1; (+) strand; PAM type: YTN; PAM sequence: TTT
catcatttgtctgtgactca

SEQ ID NO: 299523 - DNA, 20 bp, Artificial Sequence
  Description of Artificial Sequence: Synthetic oligonucleotide
  Target: ATXN1; (+) strand; PAM type: YTN; PAM sequence: TTC
atcatttgtctgtgactcag

SEQ ID NO: 299524 - DNA, 20 bp, Artificial Sequence
  Description of Artificial Sequence: Synthetic oligonucleotide
  Target: ATXN1; (+) strand; PAM type: YTN; PAM sequence: TTT
gtctgtgactcagaggcaga

SEQ ID NO: 299525 - DNA, 20 bp, Artificial Sequence
  Description of Artificial Sequence: Synthetic oligonucleotide
  Target: ATXN1; (+) strand; PAM type: YTN; PAM sequence: TTG
tctgtgactcagaggcagac

SEQ ID NO: 299526 - DNA, 20 bp, Artificial Sequence
  Description of Artificial Sequence: Synthetic oligonucleotide
  Target: ATXN1; (+) strand; PAM type: YTN; PAM sequence: CTG
tgactcagaggcagaccatg

SEQ ID NO: 299527 - DNA, 20 bp, Artificial Sequence
  Description of Artificial Sequence: Synthetic oligonucleotide
  Target: ATXN1; (+) strand; PAM type: YTN; PAM sequence: CTC
agaggcagaccatggggcca

SEQ ID NO: 299528 - DNA, 20 bp, Artificial Sequence
  Description of Artificial Sequence: Synthetic oligonucleotide
  Target: ATXN1; (+) strand; PAM type: YTN; PAM sequence: CTT
gaaggcacagggatatctag

SEQ ID NO: 299529 - DNA, 20 bp, Artificial Sequence
  Description of Artificial Sequence: Synthetic oligonucleotide
  Target: ATXN1; (+) strand; PAM type: YTN; PAM sequence: TTG
aaggcacagggatatctaga

SEQ ID NO: 299530 - DNA, 20 bp, Artificial Sequence
  Description of Artificial Sequence: Synthetic oligonucleotide
  Target: ATXN1; (+) strand; PAM type: YTN; PAM sequence: CTA
gaagtcatcccccaaacttc

SEQ ID NO: 299531 - DNA, 20 bp, Artificial Sequence
  Description of Artificial Sequence: Synthetic oligonucleotide
  Target: ATXN1; (+) strand; PAM type: YTN; PAM sequence: CTT
cagggactattgtcaaacct

SEQ ID NO: 299532 - DNA, 20 bp, Artificial Sequence
  Description of Artificial Sequence: Synthetic oligonucleotide
  Target: ATXN1; (+) strand; PAM type: YTN; PAM sequence: TTC
agggactattgtcaaacctt

SEQ ID NO: 299533 - DNA, 20 bp, Artificial Sequence
  Description of Artificial Sequence: Synthetic oligonucleotide
  Target: ATXN1; (+) strand; PAM type: YTN; PAM sequence: CTA
ttgtcaaaccttcttgggat

SEQ ID NO: 299534 - DNA, 20 bp, Artificial Sequence
  Description of Artificial Sequence: Synthetic oligonucleotide
  Target: ATXN1; (+) strand; PAM type: YTN; PAM sequence: TTG
tcaaaccttcttgggataca

SEQ ID NO: 299535 - DNA, 20 bp, Artificial Sequence
  Description of Artificial Sequence: Synthetic oligonucleotide
  Target: ATXN1; (+) strand; PAM type: YTN; PAM sequence: CTT
cttgggatacagacatattt

SEQ ID NO: 299536 - DNA, 20 bp, Artificial Sequence
  Description of Artificial Sequence: Synthetic oligonucleotide
  Target: ATXN1; (+) strand; PAM type: YTN; PAM sequence: TTC
ttgggatacagacatatttc

SEQ ID NO: 299537 - DNA, 20 bp, Artificial Sequence
  Description of Artificial Sequence: Synthetic oligonucleotide
  Target: ATXN1; (+) strand; PAM type: YTN; PAM sequence: CTT
gggatacagacatatttctc

SEQ ID NO: 299538 - DNA, 20 bp, Artificial Sequence
  Description of Artificial Sequence: Synthetic oligonucleotide
  Target: ATXN1; (+) strand; PAM type: YTN; PAM sequence: TTG
ggatacagacatatttctca

SEQ ID NO: 299539 - DNA, 20 bp, Artificial Sequence
  Description of Artificial Sequence: Synthetic oligonucleotide
  Target: ATXN1; (+) strand; PAM type: YTN; PAM sequence: TTT
ctcagatctcctttggaaag

SEQ ID NO: 299540 - DNA, 20 bp, Artificial Sequence
  Description of Artificial Sequence: Synthetic oligonucleotide
  Target: ATXN1; (+) strand; PAM type: YTN; PAM sequence: TTC
tcagatctcctttggaaaga

SEQ ID NO: 299541 - DNA, 20 bp, Artificial Sequence
  Description of Artificial Sequence: Synthetic oligonucleotide
  Target: ATXN1; (+) strand; PAM type: YTN; PAM sequence: CTC
agatctcctttggaaagatc

SEQ ID NO: 299542 - DNA, 20 bp, Artificial Sequence
  Description of Artificial Sequence: Synthetic oligonucleotide
  Target: ATXN1; (+) strand; PAM type: YTN; PAM sequence: CTC
ctttggaaagatcttagact

SEQ ID NO: 299543 - DNA, 20 bp, Artificial Sequence
  Description of Artificial Sequence: Synthetic oligonucleotide
  Target: ATXN1; (+) strand; PAM type: YTN; PAM sequence: CTT
tggaaagatcttagacttgc

SEQ ID NO: 299544 - DNA, 20 bp, Artificial Sequence
  Description of Artificial Sequence: Synthetic oligonucleotide
  Target: ATXN1; (+) strand; PAM type: YTN; PAM sequence: TTT
ggaaagatcttagacttgct

SEQ ID NO: 299545 - DNA, 20 bp, Artificial Sequence
  Description of Artificial Sequence: Synthetic oligonucleotide
  Target: ATXN1; (+) strand; PAM type: YTN; PAM sequence: TTG
gaaagatcttagacttgctt

SEQ ID NO: 299546 - DNA, 20 bp, Artificial Sequence
  Description of Artificial Sequence: Synthetic oligonucleotide
  Target: ATXN1; (+) strand; PAM type: YTN; PAM sequence: CTT
agacttgcttgacaggggtc

SEQ ID NO: 299547 - DNA, 20 bp, Artificial Sequence
  Description of Artificial Sequence: Synthetic oligonucleotide
  Target: ATXN1; (+) strand; PAM type: YTN; PAM sequence: TTA
gacttgcttgacaggggtcc

SEQ ID NO: 299548 - DNA, 20 bp, Artificial Sequence
  Description of Artificial Sequence: Synthetic oligonucleotide
  Target: ATXN1; (+) strand; PAM type: YTN; PAM sequence: CTT
gcttgacaggggtccttgga

SEQ ID NO: 299549 - DNA, 20 bp, Artificial Sequence
  Description of Artificial Sequence: Synthetic oligonucleotide
  Target: ATXN1; (+) strand; PAM type: YTN; PAM sequence: TTG
cttgacaggggtccttggag

SEQ ID NO: 299550 - DNA, 20 bp, Artificial Sequence
  Description of Artificial Sequence: Synthetic oligonucleotide
  Target: ATXN1; (+) strand; PAM type: YTN; PAM sequence: CTT
gacaggggtccttggagatg

SEQ ID NO: 299551 - DNA, 20 bp, Artificial Sequence
  Description of Artificial Sequence: Synthetic oligonucleotide
  Target: ATXN1; (+) strand; PAM type: YTN; PAM sequence: TTG
acaggggtccttggagatga

SEQ ID NO: 299552 - DNA, 20 bp, Artificial Sequence
  Description of Artificial Sequence: Synthetic oligonucleotide
  Target: ATXN1; (+) strand; PAM type: YTN; PAM sequence: CTT
ggagatgatcaaatccataa

SEQ ID NO: 299553 - DNA, 20 bp, Artificial Sequence
  Description of Artificial Sequence: Synthetic oligonucleotide
  Target: ATXN1; (+) strand; PAM type: YTN; PAM sequence: TTG
gagatgatcaaatccataac

SEQ ID NO: 299554 - DNA, 20 bp, Artificial Sequence
  Description of Artificial Sequence: Synthetic oligonucleotide
  Target: ATXN1; (+) strand; PAM type: YTN; PAM sequence: CTC
ctctcattttaaagttttct

SEQ ID NO: 299555 - DNA, 20 bp, Artificial Sequence
  Description of Artificial Sequence: Synthetic oligonucleotide
  Target: ATXN1; (+) strand; PAM type: YTN; PAM sequence: CTC
tcattttaaagttttcttta

SEQ ID NO: 299556 - DNA, 20 bp, Artificial Sequence
  Description of Artificial Sequence: Synthetic oligonucleotide
  Target: ATXN1; (+) strand; PAM type: YTN; PAM sequence: CTC
attttaaagttttctttatt

SEQ ID NO: 299557 - DNA, 20 bp, Artificial Sequence
  Description of Artificial Sequence: Synthetic oligonucleotide
  Target: ATXN1; (+) strand; PAM type: YTN; PAM sequence: TTT
taaagttttctttattggat

SEQ ID NO: 299558 - DNA, 20 bp, Artificial Sequence
  Description of Artificial Sequence: Synthetic oligonucleotide
  Target: ATXN1; (+) strand; PAM type: YTN; PAM sequence: TTT
aaagttttctttattggatt

SEQ ID NO: 299559 - DNA, 20 bp, Artificial Sequence
  Description of Artificial Sequence: Synthetic oligonucleotide
  Target: ATXN1; (+) strand; PAM type: YTN; PAM sequence: TTA
aagttttctttattggattc

SEQ ID NO: 299560 - DNA, 20 bp, Artificial Sequence
  Description of Artificial Sequence: Synthetic oligonucleotide
  Target: ATXN1; (+) strand; PAM type: YTN; PAM sequence: TTT
tctttattggattctttatg

SEQ ID NO: 299561 - DNA, 20 bp, Artificial Sequence
  Description of Artificial Sequence: Synthetic oligonucleotide
  Target: ATXN1; (+) strand; PAM type: YTN; PAM sequence: TTT
ctttattggattctttatgg

SEQ ID NO: 299562 - DNA, 20 bp, Artificial Sequence
  Description of Artificial Sequence: Synthetic oligonucleotide
  Target: ATXN1; (+) strand; PAM type: YTN; PAM sequence: TTC
tttattggattctttatggg

SEQ ID NO: 299563 - DNA, 20 bp, Artificial Sequence
  Description of Artificial Sequence: Synthetic oligonucleotide
  Target: ATXN1; (+) strand; PAM type: YTN; PAM sequence: CTT
tattggattctttatgggag

SEQ ID NO: 299564 - DNA, 20 bp, Artificial Sequence
  Description of Artificial Sequence: Synthetic oligonucleotide
  Target: ATXN1; (+) strand; PAM type: YTN; PAM sequence: TTT
attggattctttatgggaga

SEQ ID NO: 299565 - DNA, 20 bp, Artificial Sequence
  Description of Artificial Sequence: Synthetic oligonucleotide
  Target: ATXN1; (+) strand; PAM type: YTN; PAM sequence: TTA
ttggattctttatgggagac

SEQ ID NO: 299566 - DNA, 20 bp, Artificial Sequence
  Description of Artificial Sequence: Synthetic oligonucleotide
  Target: ATXN1; (+) strand; PAM type: YTN; PAM sequence: TTG
gattctttatgggagaccaa

SEQ ID NO: 299567 - DNA, 20 bp, Artificial Sequence
  Description of Artificial Sequence: Synthetic oligonucleotide
  Target: ATXN1; (+) strand; PAM type: YTN; PAM sequence: TTC
tttatgggagaccaagttcc

SEQ ID NO: 299568 - DNA, 20 bp, Artificial Sequence
  Description of Artificial Sequence: Synthetic oligonucleotide
  Target: ATXN1; (+) strand; PAM type: YTN; PAM sequence: CTT
tatgggagaccaagttcctt

SEQ ID NO: 299569 - DNA, 20 bp, Artificial Sequence
  Description of Artificial Sequence: Synthetic oligonucleotide
  Target: ATXN1; (+) strand; PAM type: YTN; PAM sequence: TTT
atgggagaccaagttcctta

SEQ ID NO: 299570 - DNA, 20 bp, Artificial Sequence
  Description of Artificial Sequence: Synthetic oligonucleotide
  Target: ATXN1; (+) strand; PAM type: YTN; PAM sequence: TTA
tgggagaccaagttccttat

SEQ ID NO: 299571 - DNA, 20 bp, Artificial Sequence
  Description of Artificial Sequence: Synthetic oligonucleotide
  Target: ATXN1; (+) strand; PAM type: YTN; PAM sequence: TTC
cttattggattgcttcctgt

SEQ ID NO: 299572 - DNA, 20 bp, Artificial Sequence
  Description of Artificial Sequence: Synthetic oligonucleotide
  Target: ATXN1; (+) strand; PAM type: YTN; PAM sequence: CTT
attggattgcttcctgtgga

SEQ ID NO: 299573 - DNA, 20 bp, Artificial Sequence
  Description of Artificial Sequence: Synthetic oligonucleotide
  Target: ATXN1; (+) strand; PAM type: YTN; PAM sequence: TTA
ttggattgcttcctgtggac

SEQ ID NO: 299574 - DNA, 20 bp, Artificial Sequence
  Description of Artificial Sequence: Synthetic oligonucleotide
  Target: ATXN1; (+) strand; PAM type: YTN; PAM sequence: TTG
gattgcttcctgtggaccaa

SEQ ID NO: 299575 - DNA, 20 bp, Artificial Sequence
  Description of Artificial Sequence: Synthetic oligonucleotide
  Target: ATXN1; (+) strand; PAM type: YTN; PAM sequence: TTG
cttcctgtggaccaaggatg

SEQ ID NO: 299576 - DNA, 20 bp, Artificial Sequence
  Description of Artificial Sequence: Synthetic oligonucleotide
  Target: ATXN1; (+) strand; PAM type: YTN; PAM sequence: CTT
cctgtggaccaaggatgatg

SEQ ID NO: 299577 - DNA, 20 bp, Artificial Sequence
  Description of Artificial Sequence: Synthetic oligonucleotide
  Target: ATXN1; (+) strand; PAM type: YTN; PAM sequence: TTC
ctgtggaccaaggatgatgt

SEQ ID NO: 299578 - DNA, 20 bp, Artificial Sequence
  Description of Artificial Sequence: Synthetic oligonucleotide
  Target: ATXN1; (+) strand; PAM type: YTN; PAM sequence: CTG
tggaccaaggatgatgtttt

SEQ ID NO: 299579 - DNA, 20 bp, Artificial Sequence
  Description of Artificial Sequence: Synthetic oligonucleotide
  Target: ATXN1; (+) strand; PAM type: YTN; PAM sequence: TTT
tctagggacttattgaaact

SEQ ID NO: 299580 - DNA, 20 bp, Artificial Sequence
  Description of Artificial Sequence: Synthetic oligonucleotide
  Target: ATXN1; (+) strand; PAM type: YTN; PAM sequence: TTT
ctagggacttattgaaactt

SEQ ID NO: 299581 - DNA, 20 bp, Artificial Sequence
  Description of Artificial Sequence: Synthetic oligonucleotide
  Target: ATXN1; (+) strand; PAM type: YTN; PAM sequence: TTC
tagggacttattgaaacttg

SEQ ID NO: 299582 - DNA, 20 bp, Artificial Sequence
  Description of Artificial Sequence: Synthetic oligonucleotide
  Target: ATXN1; (+) strand; PAM type: YTN; PAM sequence: CTA
gggacttattgaaacttgag

SEQ ID NO: 299583 - DNA, 20 bp, Artificial Sequence
  Description of Artificial Sequence: Synthetic oligonucleotide
  Target: ATXN1; (+) strand; PAM type: YTN; PAM sequence: CTT
attgaaacttgagagtcgga

SEQ ID NO: 299584 - DNA, 20 bp, Artificial Sequence
  Description of Artificial Sequence: Synthetic oligonucleotide
  Target: ATXN1; (+) strand; PAM type: YTN; PAM sequence: TTA
ttgaaacttgagagtcggaa

SEQ ID NO: 299585 - DNA, 20 bp, Artificial Sequence
  Description of Artificial Sequence: Synthetic oligonucleotide
  Target: ATXN1; (+) strand; PAM type: YTN; PAM sequence: TTG
aaacttgagagtcggaagtg

SEQ ID NO: 299586 - DNA, 20 bp, Artificial Sequence
  Description of Artificial Sequence: Synthetic oligonucleotide
  Target: ATXN1; (+) strand; PAM type: YTN; PAM sequence: CTT
gagagtcggaagtggtctga

SEQ ID NO: 299587 - DNA, 20 bp, Artificial Sequence
  Description of Artificial Sequence: Synthetic oligonucleotide
  Target: ATXN1; (+) strand; PAM type: YTN; PAM sequence: TTG
agagtcggaagtggtctgaa

SEQ ID NO: 299588 - DNA, 20 bp, Artificial Sequence
  Description of Artificial Sequence: Synthetic oligonucleotide
  Target: ATXN1; (+) strand; PAM type: YTN; PAM sequence: CTG
aaggattgtttgatttagtg

SEQ ID NO: 299589 - DNA, 20 bp, Artificial Sequence
  Description of Artificial Sequence: Synthetic oligonucleotide
  Target: ATXN1; (+) strand; PAM type: YTN; PAM sequence: TTG
tttgatttagtggtcctgtg

SEQ ID NO: 299590 - DNA, 20 bp, Artificial Sequence
  Description of Artificial Sequence: Synthetic oligonucleotide
  Target: ATXN1; (+) strand; PAM type: YTN; PAM sequence: TTT
gatttagtggtcctgtgaac

SEQ ID NO: 299591 - DNA, 20 bp, Artificial Sequence
  Description of Artificial Sequence: Synthetic oligonucleotide
  Target: ATXN1; (+) strand; PAM type: YTN; PAM sequence: TTG
atttagtggtcctgtgaact

SEQ ID NO: 299592 - DNA, 20 bp, Artificial Sequence
  Description of Artificial Sequence: Synthetic oligonucleotide
  Target: ATXN1; (+) strand; PAM type: YTN; PAM sequence: TTT
agtggtcctgtgaactgaca

SEQ ID NO: 299593 - DNA, 20 bp, Artificial Sequence
  Description of Artificial Sequence: Synthetic oligonucleotide
  Target: ATXN1; (+) strand; PAM type: YTN; PAM sequence: TTA
gtggtcctgtgaactgacat

SEQ ID NO: 299594 - DNA, 20 bp, Artificial Sequence
  Description of Artificial Sequence: Synthetic oligonucleotide
  Target: ATXN1; (+) strand; PAM type: YTN; PAM sequence: CTG
tgaactgacattgcctaata

SEQ ID NO: 299595 - DNA, 20 bp, Artificial Sequence
  Description of Artificial Sequence: Synthetic oligonucleotide
  Target: ATXN1; (+) strand; PAM type: YTN; PAM sequence: CTG
acattgcctaatagctgttg

SEQ ID NO: 299596 - DNA, 20 bp, Artificial Sequence
  Description of Artificial Sequence: Synthetic oligonucleotide
  Target: ATXN1; (+) strand; PAM type: YTN; PAM sequence: TTG
cctaatagctgttgtaacat

SEQ ID NO: 299597 - DNA, 20 bp, Artificial Sequence
  Description of Artificial Sequence: Synthetic oligonucleotide
  Target: ATXN1; (+) strand; PAM type: YTN; PAM sequence: CTA
atagctgttgtaacataaag

SEQ ID NO: 299598 - DNA, 20 bp, Artificial Sequence
  Description of Artificial Sequence: Synthetic oligonucleotide
  Target: ATXN1; (+) strand; PAM type: YTN; PAM sequence: CTG
ttgtaacataaagattctca

SEQ ID NO: 299599 - DNA, 20 bp, Artificial Sequence
  Description of Artificial Sequence: Synthetic oligonucleotide
  Target: ATXN1; (+) strand; PAM type: YTN; PAM sequence: TTG
taacataaagattctcaggt

SEQ ID NO: 299600 - DNA, 20 bp, Artificial Sequence
  Description of Artificial Sequence: Synthetic oligonucleotide
  Target: ATXN1; (+) strand; PAM type: YTN; PAM sequence: TTC
tcaggtctcagccccacccc

SEQ ID NO: 299601 - DNA, 20 bp, Artificial Sequence
  Description of Artificial Sequence: Synthetic oligonucleotide
  Target: ATXN1; (+) strand; PAM type: YTN; PAM sequence: CTC
aggtctcagccccacccctt

SEQ ID NO: 299602 - DNA, 20 bp, Artificial Sequence
  Description of Artificial Sequence: Synthetic oligonucleotide
  Target: ATXN1; (+) strand; PAM type: YTN; PAM sequence: CTC
agccccaccccttacccaaa

SEQ ID NO: 299603 - DNA, 20 bp, Artificial Sequence
  Description of Artificial Sequence: Synthetic oligonucleotide
  Target: ATXN1; (+) strand; PAM type: YTN; PAM sequence: CTT
acccaaacccttggctaatt

SEQ ID NO: 299604 - DNA, 20 bp, Artificial Sequence
  Description of Artificial Sequence: Synthetic oligonucleotide
  Target: ATXN1; (+) strand; PAM type: YTN; PAM sequence: TTA
cccaaacccttggctaattc

SEQ ID NO: 299605 - DNA, 20 bp, Artificial Sequence
  Description of Artificial Sequence: Synthetic oligonucleotide
  Target: ATXN1; (+) strand; PAM type: YTN; PAM sequence: CTT
ggctaattccacagaggcct

SEQ ID NO: 299606 - DNA, 20 bp, Artificial Sequence
  Description of Artificial Sequence: Synthetic oligonucleotide
  Target: ATXN1; (+) strand; PAM type: YTN; PAM sequence: TTG
gctaattccacagaggcctg

SEQ ID NO: 299607 - DNA, 20 bp, Artificial Sequence
  Description of Artificial Sequence: Synthetic oligonucleotide
  Target: ATXN1; (+) strand; PAM type: YTN; PAM sequence: CTA
attccacagaggcctgtctc

SEQ ID NO: 299608 - DNA, 20 bp, Artificial Sequence
  Description of Artificial Sequence: Synthetic oligonucleotide
  Target: ATXN1; (+) strand; PAM type: YTN; PAM sequence: TTC
cacagaggcctgtctcactc

SEQ ID NO: 299609 - DNA, 20 bp, Artificial Sequence
  Description of Artificial Sequence: Synthetic oligonucleotide
  Target: ATXN1; (+) strand; PAM type: YTN; PAM sequence: CTG
tctcactctgtcgcccaggc

SEQ ID NO: 299610 - DNA, 20 bp, Artificial Sequence
  Description of Artificial Sequence: Synthetic oligonucleotide
  Target: ATXN1; (+) strand; PAM type: YTN; PAM sequence: CTC
actctgtcgcccaggctgga

SEQ ID NO: 299611 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggagtgc

SEQ ID NO: 299612 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggagtgcag

SEQ ID NO: 299613 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggctctccagg

SEQ ID NO: 299614 - DNA, 20 bp, Artificial Sequence
  Description of Artificial Sequence: Synthetic oligonucleotide
  Target: ATXN1; (+) strand; PAM type: YTN; PAM sequence: CTC
tccagggttttctgaagcca

SEQ ID NO: 299615 - DNA, 20 bp, Artificial Sequence
  Description of Artificial Sequence: Synthetic oligonucleotide
  Target: ATXN1; (+) strand; PAM type: YTN; PAM sequence: CTC
cagggttttctgaagccaca

SEQ ID NO: 299616 - DNA, 20 bp, Artificial Sequence
  Description of Artificial Sequence: Synthetic oligonucleotide
  Target: ATXN1; (+) strand; PAM type: YTN; PAM sequence: TTT
tctgaagccacatttgaaaa

SEQ ID NO: 299617 - DNA, 20 bp, Artificial Sequence
  Description of Artificial Sequence: Synthetic oligonucleotide
  Target: ATXN1; (+) strand; PAM type: YTN; PAM sequence: TTT
ctgaagccacatttgaaaac

SEQ ID NO: 299618 - DNA, 20 bp, Artificial Sequence
  Description of Artificial Sequence: Synthetic oligonucleotide
  Target: ATXN1; (+) strand; PAM type: YTN; PAM sequence: TTC
tgaagccacatttgaaaacc

SEQ ID NO: 299619 - DNA, 20 bp, Artificial Sequence
  Description of Artificial Sequence: Synthetic oligonucleotide
  Target: ATXN1; (+) strand; PAM type: YTN; PAM sequence: CTG
aagccacatttgaaaaccac

SEQ ID NO: 299620 - DNA, 20 bp, Artificial Sequence
  Description of Artificial Sequence: Synthetic oligonucleotide
  Target: ATXN1; (+) strand; PAM type: YTN; PAM sequence: TTT
gaaaaccacttatataaccc

SEQ ID NO: 299621 - DNA, 20 bp, Artificial Sequence
  Description of Artificial Sequence: Synthetic oligonucleotide
  Target: ATXN1; (+) strand; PAM type: YTN; PAM sequence: TTG
aaaaccacttatataaccca

SEQ ID NO: 299622 - DNA, 20 bp, Artificial Sequence
  Description of Artificial Sequence: Synthetic oligonucleotide
  Target: ATXN1; (+) strand; PAM type: YTN; PAM sequence: CTT
atataacccaacttcctcat

SEQ ID NO: 299623 - DNA, 20 bp, Artificial Sequence
  Description of Artificial Sequence: Synthetic oligonucleotide
  Target: ATXN1; (+) strand; PAM type: YTN; PAM sequence: TTA
tataacccaacttcctcatt

SEQ ID NO: 299624 - DNA, 20 bp, Artificial Sequence
  Description of Artificial Sequence: Synthetic oligonucleotide
  Target: ATXN1; (+) strand; PAM type: YTN; PAM sequence: CTT
cctcattttcctaaggctca

SEQ ID NO: 299625 - DNA, 20 bp, Artificial Sequence
  Description of Artificial Sequence: Synthetic oligonucleotide
  Target: ATXN1; (+) strand; PAM type: YTN; PAM sequence: TTC
ctcattttcctaaggctcag

SEQ ID NO: 299626 - DNA, 20 bp, Artificial Sequence
  Description of Artificial Sequence: Synthetic oligonucleotide
  Target: ATXN1; (+) strand; PAM type: YTN; PAM sequence: CTC
attttcctaaggctcagaga

SEQ ID NO: 299627 - DNA, 20 bp, Artificial Sequence
  Description of Artificial Sequence: Synthetic oligonucleotide
  Target: ATXN1; (+) strand; PAM type: YTN; PAM sequence: TTT
tcctaaggctcagagaactt

SEQ ID NO: 299628 - DNA, 20 bp, Artificial Sequence
  Description of Artificial Sequence: Synthetic oligonucleotide
  Target: ATXN1; (+) strand; PAM type: YTN; PAM sequence: TTT
cctaaggctcagagaacttc

SEQ ID NO: 299629 - DNA, 20 bp, Artificial Sequence
  Description of Artificial Sequence: Synthetic oligonucleotide
  Target: ATXN1; (+) strand; PAM type: YTN; PAM sequence: TTC
ctaaggctcagagaacttcg

SEQ ID NO: 299630 - DNA, 20 bp, Artificial Sequence
  Description of Artificial Sequence: Synthetic oligonucleotide
  Target: ATXN1; (+) strand; PAM type: YTN; PAM sequence: CTA
aggctcagagaacttcggtt

SEQ ID NO: 299631 - DNA, 20 bp, Artificial Sequence
  Description of Artificial Sequence: Synthetic oligonucleotide
  Target: ATXN1; (+) strand; PAM type: YTN; PAM sequence: CTC
agagaacttcggttatttgc

SEQ ID NO: 299632 - DNA, 20 bp, Artificial Sequence
  Description of Artificial Sequence: Synthetic oligonucleotide
  Target: ATXN1; (+) strand; PAM type: YTN; PAM sequence: CTT
cggttatttgccaaaggccg

SEQ ID NO: 299633 - DNA, 20 bp, Artificial Sequence
  Description of Artificial Sequence: Synthetic oligonucleotide
  Target: ATXN1; (+) strand; PAM type: YTN; PAM sequence: TTC
ggttatttgccaaaggccgc

SEQ ID NO: 299634 - DNA, 20 bp, Artificial Sequence
  Description of Artificial Sequence: Synthetic oligonucleotide
  Target: ATXN1; (+) strand; PAM type: YTN; PAM sequence: TTA
tttgccaaaggccgcacaac

SEQ ID NO: 299635 - DNA, 20 bp, Artificial Sequence
  Description of Artificial Sequence: Synthetic oligonucleotide
  Target: ATXN1; (+) strand; PAM type: YTN; PAM sequence: TTT
gccaaaggccgcacaacagt

SEQ ID NO: 299636 - DNA, 20 bp, Artificial Sequence
  Description of Artificial Sequence: Synthetic oligonucleotide
  Target: ATXN1; (+) strand; PAM type: YTN; PAM sequence: TTG
ccaaaggccgcacaacagtt

SEQ ID NO: 299637 - DNA, 20 bp, Artificial Sequence
  Description of Artificial Sequence: Synthetic oligonucleotide
  Target: ATXN1; (+) strand; PAM type: YTN; PAM sequence: TTA
atgacaggcctaagacttcc

SEQ ID NO: 299638 - DNA, 20 bp, Artificial Sequence
  Description of Artificial Sequence: Synthetic oligonucleotide
  Target: ATXN1; (+) strand; PAM type: YTN; PAM sequence: CTA
agacttccacccagttccca

SEQ ID NO: 299639 - DNA, 20 bp, Artificial Sequence
  Description of Artificial Sequence: Synthetic oligonucleotide
  Target: ATXN1; (+) strand; PAM type: YTN; PAM sequence: CTT
ccacccagttcccagcgtgc

SEQ ID NO: 299640 - DNA, 20 bp, Artificial Sequence
  Description of Artificial Sequence: Synthetic oligonucleotide
  Target: ATXN1; (+) strand; PAM type: YTN; PAM sequence: TTC
cacccagttcccagcgtgct

SEQ ID NO: 299641 - DNA, 20 bp, Artificial Sequence
  Description of Artificial Sequence: Synthetic oligonucleotide
  Target: ATXN1; (+) strand; PAM type: YTN; PAM sequence: TTC
ccagcgtgctcaaccagtga

SEQ ID NO: 299642 - DNA, 20 bp, Artificial Sequence
  Description of Artificial Sequence: Synthetic oligonucleotide
  Target: ATXN1; (+) strand; PAM type: YTN; PAM sequence: CTC
aaccagtgatggtctttgca

SEQ ID NO: 299643 - DNA, 20 bp, Artificial Sequence
  Description of Artificial Sequence: Synthetic oligonucleotide
  Target: ATXN1; (+) strand; PAM type: YTN; PAM sequence: CTT
tgcatttactttctgagcat

SEQ ID NO: 299644 - DNA, 20 bp, Artificial Sequence
  Description of Artificial Sequence: Synthetic oligonucleotide
  Target: ATXN1; (+) strand; PAM type: YTN; PAM sequence: TTT
gcatttactttctgagcatt

SEQ ID NO: 299645 - DNA, 20 bp, Artificial Sequence
  Description of Artificial Sequence: Synthetic oligonucleotide
  Target: ATXN1; (+) strand; PAM type: YTN; PAM sequence: TTG
catttactttctgagcattt

SEQ ID NO: 299646 - DNA, 20 bp, Artificial Sequence
  Description of Artificial Sequence: Synthetic oligonucleotide
  Target: ATXN1; (+) strand; PAM type: YTN; PAM sequence: TTT
actttctgagcatttagcgt

SEQ ID NO: 299647 - DNA, 20 bp, Artificial Sequence
  Description of Artificial Sequence: Synthetic oligonucleotide
  Target: ATXN1; (+) strand; PAM type: YTN; PAM sequence: TTA
ctttctgagcatttagcgtt

SEQ ID NO: 299648 - DNA, 20 bp, Artificial Sequence
  Description of Artificial Sequence: Synthetic oligonucleotide
  Target: ATXN1; (+) strand; PAM type: YTN; PAM sequence: CTT
tctgagcatttagcgttcag

SEQ ID NO: 299649 - DNA, 20 bp, Artificial Sequence
  Description of Artificial Sequence: Synthetic oligonucleotide
  Target: ATXN1; (+) strand; PAM type: YTN; PAM sequence: TTT
ctgagcatttagcgttcagt

SEQ ID NO: 299650 - DNA, 20 bp, Artificial Sequence
  Description of Artificial Sequence: Synthetic oligonucleotide
  Target: ATXN1; (+) strand; PAM type: YTN; PAM sequence: TTC
tgagcatttagcgttcagta

SEQ ID NO: 299651 - DNA, 20 bp, Artificial Sequence
  Description of Artificial Sequence: Synthetic oligonucleotide
  Target: ATXN1; (+) strand; PAM type: YTN; PAM sequence: CTG
agcatttagcgttcagtaaa

SEQ ID NO: 299652 - DNA, 20 bp, Artificial Sequence
  Description of Artificial Sequence: Synthetic oligonucleotide
  Target: ATXN1; (+) strand; PAM type: YTN; PAM sequence: TTT
agcgttcagtaaaacctcaa

SEQ ID NO: 299653 - DNA, 20 bp, Artificial Sequence
  Description of Artificial Sequence: Synthetic oligonucleotide
  Target: ATXN1; (+) strand; PAM type: YTN; PAM sequence: TTA
gcgttcagtaaaacctcaat

SEQ ID NO: 299654 - DNA, 20 bp, Artificial Sequence
  Description of Artificial Sequence: Synthetic oligonucleotide
  Target: ATXN1; (+) strand; PAM type: YTN; PAM sequence: TTC
agtaaaacctcaatcattta

SEQ ID NO: 299655 - DNA, 20 bp, Artificial Sequence
  Description of Artificial Sequence: Synthetic oligonucleotide
  Target: ATXN1; (+) strand; PAM type: YTN; PAM sequence: CTC
aatcatttactctctgctaa

SEQ ID NO: 299656 - DNA, 20 bp, Artificial Sequence
  Description of Artificial Sequence: Synthetic oligonucleotide
  Target: ATXN1; (+) strand; PAM type: YTN; PAM sequence: TTT
actctctgctaatagagata

SEQ ID NO: 299657 - DNA, 20 bp, Artificial Sequence
  Description of Artificial Sequence: Synthetic oligonucleotide
  Target: ATXN1; (+) strand; PAM type: YTN; PAM sequence: TTA
ctctctgctaatagagataa

SEQ ID NO: 299658 - DNA, 20 bp, Artificial Sequence
  Description of Artificial Sequence: Synthetic oligonucleotide
  Target: ATXN1; (+) strand; PAM type: YTN; PAM sequence: CTC
tctgctaatagagataatgt

SEQ ID NO: 299659 - DNA, 20 bp, Artificial Sequence
  Description of Artificial Sequence: Synthetic oligonucleotide
  Target: ATXN1; (+) strand; PAM type: YTN; PAM sequence: CTC
tgctaatagagataatgtat

SEQ ID NO: 299660 - DNA, 20 bp, Artificial Sequence
  Description of Artificial Sequence: Synthetic oligonucleotide
  Target: ATXN1; (+) strand; PAM type: YTN; PAM sequence: CTG
ctaatagagataatgtattc

SEQ ID NO: 299661 - DNA, 20 bp, Artificial Sequence
  Description of Artificial Sequence: Synthetic oligonucleotide
  Target: ATXN1; (+) strand; PAM type: YTN; PAM sequence: CTA
atagagataatgtattctta

SEQ ID NO: 299662 - DNA, 20 bp, Artificial Sequence
  Description of Artificial Sequence: Synthetic oligonucleotide
  Target: ATXN1; (+) strand; PAM type: YTN; PAM sequence: TTC
ttaatgaatatataattcaa

SEQ ID NO: 299663 - DNA, 20 bp, Artificial Sequence
  Description of Artificial Sequence: Synthetic oligonucleotide
  Target: ATXN1; (+) strand; PAM type: YTN; PAM sequence: CTT
aatgaatatataattcaatt

SEQ ID NO: 299664 - DNA, 20 bp, Artificial Sequence
  Description of Artificial Sequence: Synthetic oligonucleotide
  Target: ATXN1; (+) strand; PAM type: YTN; PAM sequence: TTA
atgaatatataattcaattt

SEQ ID NO: 299665 - DNA, 20 bp, Artificial Sequence
  Description of Artificial Sequence: Synthetic oligonucleotide
  Target: ATXN1; (+) strand; PAM type: YTN; PAM sequence: TTC
aatttccttgaatgtattat

SEQ ID NO: 299666 - DNA, 20 bp, Artificial Sequence
  Description of Artificial Sequence: Synthetic oligonucleotide
  Target: ATXN1; (+) strand; PAM type: YTN; PAM sequence: TTT
ccttgaatgtattatataac

SEQ ID NO: 299667 - DNA, 20 bp, Artificial Sequence
  Description of Artificial Sequence: Synthetic oligonucleotide
  Target: ATXN1; (+) strand; PAM type: YTN; PAM sequence: TTC
cttgaatgtattatataacc

SEQ ID NO: 299668 - DNA, 20 bp, Artificial Sequence
  Description of Artificial Sequence: Synthetic oligonucleotide
  Target: ATXN1; (+) strand; PAM type: YTN; PAM sequence: CTT
gaatgtattatataacctat

SEQ ID NO: 299669 - DNA, 20 bp, Artificial Sequence
  Description of Artificial Sequence: Synthetic oligonucleotide
  Target: ATXN1; (+) strand; PAM type: YTN; PAM sequence: TTG
aatgtattatataacctata

SEQ ID NO: 299670 - DNA, 20 bp, Artificial Sequence
  Description of Artificial Sequence: Synthetic oligonucleotide
  Target: ATXN1; (+) strand; PAM type: YTN; PAM sequence: TTA
tataacctataaaattttag

SEQ ID NO: 299671 - DNA, 20 bp, Artificial Sequence
  Description of Artificial Sequence: Synthetic oligonucleotide
  Target: ATXN1; (+) strand; PAM type: YTN; PAM sequence: CTA
taaaattttaggatcttatt

SEQ ID NO: 299672 - DNA, 20 bp, Artificial Sequence
  Description of Artificial Sequence: Synthetic oligonucleotide
  Target: ATXN1; (+) strand; PAM type: YTN; PAM sequence: TTT
taggatcttattagcaagtt

SEQ ID NO: 299673 - DNA, 20 bp, Artificial Sequence
  Description of Artificial Sequence: Synthetic oligonucleotide
  Target: ATXN1; (+) strand; PAM type: YTN; PAM sequence: TTT
aggatcttattagcaagtta

SEQ ID NO: 299674 - DNA, 20 bp, Artificial Sequence
  Description of Artificial Sequence: Synthetic oligonucleotide
  Target: ATXN1; (+) strand; PAM type: YTN; PAM sequence: TTA
ggatcttattagcaagttaa

SEQ ID NO: 299675 - DNA, 20 bp, Artificial Sequence
  Description of Artificial Sequence: Synthetic oligonucleotide
  Target: ATXN1; (+) strand; PAM type: YTN; PAM sequence: CTT
attagcaagttaaatgtctc

SEQ ID NO: 299676 - DNA, 20 bp, Artificial Sequence
  Description of Artificial Sequence: Synthetic oligonucleotide
  Target: ATXN1; (+) strand; PAM type: YTN; PAM sequence: TTA
ttagcaagttaaatgtctcc

SEQ ID NO: 299677 - DNA, 20 bp, Artificial Sequence
  Description of Artificial Sequence: Synthetic oligonucleotide
  Target: ATXN1; (+) strand; PAM type: YTN; PAM sequence: TTA
gcaagttaaatgtctccttt

SEQ ID NO: 299678 - DNA, 20 bp, Artificial Sequence
  Description of Artificial Sequence: Synthetic oligonucleotide
  Target: ATXN1; (+) strand; PAM type: YTN; PAM sequence: TTA
aatgtctcctttcttaaatt

SEQ ID NO: 299679 - DNA, 20 bp, Artificial Sequence
  Description of Artificial Sequence: Synthetic oligonucleotide
  Target: ATXN1; (+) strand; PAM type: YTN; PAM sequence: CTC
ctttcttaaattagggctgg

SEQ ID NO: 299680 - DNA, 20 bp, Artificial Sequence
  Description of Artificial Sequence: Synthetic oligonucleotide
  Target: ATXN1; (+) strand; PAM type: YTN; PAM sequence: CTT
tcttaaattagggctggttt

SEQ ID NO: 299681 - DNA, 20 bp, Artificial Sequence
  Description of Artificial Sequence: Synthetic oligonucleotide
  Target: ATXN1; (+) strand; PAM type: YTN; PAM sequence: TTT
cttaaattagggctggtttt

SEQ ID NO: 299682 - DNA, 20 bp, Artificial Sequence
  Description of Artificial Sequence: Synthetic oligonucleotide
  Target: ATXN1; (+) strand; PAM type: YTN; PAM sequence: TTC
ttaaattagggctggttttt

SEQ ID NO: 299683 - DNA, 20 bp, Artificial Sequence
  Description of Artificial Sequence: Synthetic oligonucleotide
  Target: ATXN1; (+) strand; PAM type: YTN; PAM sequence: CTT
aaattagggctggttttttt

SEQ ID NO: 299684 - DNA, 20 bp, Artificial Sequence
  Description of Artificial Sequence: Synthetic oligonucleotide
  Target: ATXN1; (+) strand; PAM type: YTN; PAM sequence: TTA
aattagggctggtttttttt

SEQ ID NO: 299685 - DNA, 20 bp, Artificial Sequence
  Description of Artificial Sequence: Synthetic oligonucleotide
  Target: ATXN1; (+) strand; PAM type: YTN; PAM sequence: TTA
gggctggttttttttttttg

SEQ ID NO: 299686 - DNA, 20 bp, Artificial Sequence
  Description of Artificial Sequence: Synthetic oligonucleotide
  Target: ATXN1; (+) strand; PAM type: YTN; PAM sequence: CTG
gttttttttttttgaagaat

SEQ ID NO: 299687 - DNA, 20 bp, Artificial Sequence
  Description of Artificial Sequence: Synthetic oligonucleotide
  Target: ATXN1; (+) strand; PAM type: YTN; PAM sequence: TTT
tttttttttgaagaattaag

SEQ ID NO: 299688 - DNA, 20 bp, Artificial Sequence
  Description of Artificial Sequence: Synthetic oligonucleotide
  Target: ATXN1; (+) strand; PAM type: YTN; PAM sequence: TTT
ttttttttgaagaattaagg

SEQ ID NO: 299689 - DNA, 20 bp, Artificial Sequence
  Description of Artificial Sequence: Synthetic oligonucleotide
  Target: ATXN1; (+) strand; PAM type: YTN; PAM sequence: TTT
tttttttgaagaattaagga

SEQ ID NO: 299690 - DNA, 20 bp, Artificial Sequence
  Description of Artificial Sequence: Synthetic oligonucleotide
  Target: ATXN1; (+) strand; PAM type: YTN; PAM sequence: TTT
ttttttgaagaattaaggat

SEQ ID NO: 299691 - DNA, 20 bp, Artificial Sequence
  Description of Artificial Sequence: Synthetic oligonucleotide
  Target: ATXN1; (+) strand; PAM type: YTN; PAM sequence: TTT
tttttgaagaattaaggatt

SEQ ID NO: 299692 - DNA, 20 bp, Artificial Sequence
  Description of Artificial Sequence: Synthetic oligonucleotide
  Target: ATXN1; (+) strand; PAM type: YTN; PAM sequence: TTT
ttttgaagaattaaggattc

SEQ ID NO: 299693 - DNA, 20 bp, Artificial Sequence
  Description of Artificial Sequence: Synthetic oligonucleotide
  Target: ATXN1; (+) strand; PAM type: YTN; PAM sequence: TTT
tttgaagaattaaggattct

SEQ ID NO: 299694 - DNA, 20 bp, Artificial Sequence
  Description of Artificial Sequence: Synthetic oligonucleotide
  Target: ATXN1; (+) strand; PAM type: YTN; PAM sequence: TTT
ttgaagaattaaggattctt

SEQ ID NO: 299695 - DNA, 20 bp, Artificial Sequence
  Description of Artificial Sequence: Synthetic oligonucleotide
  Target: ATXN1; (+) strand; PAM type: YTN; PAM sequence: TTT
tgaagaattaaggattcttc

SEQ ID NO: 299696 - DNA, 20 bp, Artificial Sequence
  Description of Artificial Sequence: Synthetic oligonucleotide
  Target: ATXN1; (+) strand; PAM type: YTN; PAM sequence: TTT
gaagaattaaggattcttca

SEQ ID NO: 299697 - DNA, 20 bp, Artificial Sequence
  Description of Artificial Sequence: Synthetic oligonucleotide
  Target: ATXN1; (+) strand; PAM type: YTN; PAM sequence: TTG
aagaattaaggattcttcat

SEQ ID NO: 299698 - DNA, 20 bp, Artificial Sequence
  Description of Artificial Sequence: Synthetic oligonucleotide
  Target: ATXN1; (+) strand; PAM type: YTN; PAM sequence: TTA
aggattcttcattaattcgc

SEQ ID NO: 299699 - DNA, 20 bp, Artificial Sequence
  Description of Artificial Sequence: Synthetic oligonucleotide
  Target: ATXN1; (+) strand; PAM type: YTN; PAM sequence: TTC
ttcattaattcgccttcatg

SEQ ID NO: 299700 - DNA, 20 bp, Artificial Sequence
  Description of Artificial Sequence: Synthetic oligonucleotide
  Target: ATXN1; (+) strand; PAM type: YTN; PAM sequence: CTT
cattaattcgccttcatgtt

SEQ ID NO: 299701 - DNA, 20 bp, Artificial Sequence
  Description of Artificial Sequence: Synthetic oligonucleotide
  Target: ATXN1; (+) strand; PAM type: YTN; PAM sequence: TTC
attaattcgccttcatgttc

SEQ ID NO: 299702 - DNA, 20 bp, Artificial Sequence
  Description of Artificial Sequence: Synthetic oligonucleotide
  Target: ATXN1; (+) strand; PAM type: YTN; PAM sequence: TTA
attcgccttcatgttctaag

SEQ ID NO: 299703 - DNA, 20 bp, Artificial Sequence
  Description of Artificial Sequence: Synthetic oligonucleotide
  Target: ATXN1; (+) strand; PAM type: YTN; PAM sequence: TTC
gccttcatgttctaagagtg

SEQ ID NO: 299704 - DNA, 20 bp, Artificial Sequence
  Description of Artificial Sequence: Synthetic oligonucleotide
  Target: ATXN1; (+) strand; PAM type: YTN; PAM sequence: CTT
catgttctaagagtgataag

SEQ ID NO: 299705 - DNA, 20 bp, Artificial Sequence
  Description of Artificial Sequence: Synthetic oligonucleotide
  Target: ATXN1; (+) strand; PAM type: YTN; PAM sequence: TTC
atgttctaagagtgataaga

SEQ ID NO: 299706 - DNA, 20 bp, Artificial Sequence
  Description of Artificial Sequence: Synthetic oligonucleotide
  Target: ATXN1; (+) strand; PAM type: YTN; PAM sequence: TTC
taagagtgataagagacttc

SEQ ID NO: 299707 - DNA, 20 bp, Artificial Sequence
  Description of Artificial Sequence: Synthetic oligonucleotide
  Target: ATXN1; (+) strand; PAM type: YTN; PAM sequence: CTA
agagtgataagagacttcac

SEQ ID NO: 299708 - DNA, 20 bp, Artificial Sequence
  Description of Artificial Sequence: Synthetic oligonucleotide
  Target: ATXN1; (+) strand; PAM type: YTN; PAM sequence: CTT
cacgggaaacaaatcagaag

SEQ ID NO: 299709 - DNA, 20 bp, Artificial Sequence
  Description of Artificial Sequence: Synthetic oligonucleotide
  Target: ATXN1; (+) strand; PAM type: YTN; PAM sequence: TTC
acgggaaacaaatcagaagc

SEQ ID NO: 299710 - DNA, 20 bp, Artificial Sequence
  Description of Artificial Sequence: Synthetic oligonucleotide
  Target: ATXN1; (+) strand; PAM type: YTN; PAM sequence: TTT
tctttaggacaacgaaagaa

SEQ ID NO: 299711 - DNA, 20 bp, Artificial Sequence
  Description of Artificial Sequence: Synthetic oligonucleotide
  Target: ATXN1; (+) strand; PAM type: YTN; PAM sequence: TTT
ctttaggacaacgaaagaaa

SEQ ID NO: 299712 - DNA, 20 bp, Artificial Sequence
  Description of Artificial Sequence: Synthetic oligonucleotide
  Target: ATXN1; (+) strand; PAM type: YTN; PAM sequence: TTC
tttaggacaacgaaagaaat

SEQ ID NO: 299713 - DNA, 20 bp, Artificial Sequence
  Description of Artificial Sequence: Synthetic oligonucleotide
  Target: ATXN1; (+) strand; PAM type: YTN; PAM sequence: CTT
taggacaacgaaagaaatgg

SEQ ID NO: 299714 - DNA, 20 bp, Artificial Sequence
  Description of Artificial Sequence: Synthetic oligonucleotide
  Target: ATXN1; (+) strand; PAM type: YTN; PAM sequence: TTT
aggacaacgaaagaaatggt

SEQ ID NO: 299715 - DNA, 20 bp, Artificial Sequence
  Description of Artificial Sequence: Synthetic oligonucleotide
  Target: ATXN1; (+) strand; PAM type: YTN; PAM sequence: TTA
ggacaacgaaagaaatggtc

SEQ ID NO: 299716 - DNA, 20 bp, Artificial Sequence
  Description of Artificial Sequence: Synthetic oligonucleotide
  Target: ATXN1; (+) strand; PAM type: YTN; PAM sequence: CTA
acatatttgttaacttctac

SEQ ID NO: 299717 - DNA, 20 bp, Artificial Sequence
  Description of Artificial Sequence: Synthetic oligonucleotide
  Target: ATXN1; (+) strand; PAM type: YTN; PAM sequence: TTT
gttaacttctacagacaaca

SEQ ID NO: 299718 - DNA, 20 bp, Artificial Sequence
  Description of Artificial Sequence: Synthetic oligonucleotide
  Target: ATXN1; (+) strand; PAM type: YTN; PAM sequence: TTG
ttaacttctacagacaacac

SEQ ID NO: 299719 - DNA, 20 bp, Artificial Sequence
  Description of Artificial Sequence: Synthetic oligonucleotide
  Target: ATXN1; (+) strand; PAM type: YTN; PAM sequence: TTA
acttctacagacaacacaca

SEQ ID NO: 299720 - DNA, 20 bp, Artificial Sequence
  Description of Artificial Sequence: Synthetic oligonucleotide
  Target: ATXN1; (+) strand; PAM type: YTN; PAM sequence: CTT
ctacagacaacacacacaca

SEQ ID NO: 299721 - DNA, 20 bp, Artificial Sequence
  Description of Artificial Sequence: Synthetic oligonucleotide
  Target: ATXN1; (+) strand; PAM type: YTN; PAM sequence: TTC
tacagacaacacacacacac

SEQ ID NO: 299722 - DNA, 20 bp, Artificial Sequence
  Description of Artificial Sequence: Synthetic oligonucleotide
  Target: ATXN1; (+) strand; PAM type: YTN; PAM sequence: CTA
cagacaacacacacacacac

SEQ ID NO: 299723 - DNA, 20 bp, Artificial Sequence
  Description of Artificial Sequence: Synthetic oligonucleotide
  Target: ATXN1; (+) strand; PAM type: YTN; PAM sequence: CTC
ccacttctggctccagaaat

SEQ ID NO: 299724 - DNA, 20 bp, Artificial Sequence
  Description of Artificial Sequence: Synthetic oligonucleotide
  Target: ATXN1; (+) strand; PAM type: YTN; PAM sequence: CTT
ctggctccagaaattacttg

SEQ ID NO: 299725 - DNA, 20 bp, Artificial Sequence
  Description of Artificial Sequence: Synthetic oligonucleotide
  Target: ATXN1; (+) strand; PAM type: YTN; PAM sequence: TTC
tggctccagaaattacttgt

SEQ ID NO: 299726 - DNA, 20 bp, Artificial Sequence
  Description of Artificial Sequence: Synthetic oligonucleotide
  Target: ATXN1; (+) strand; PAM type: YTN; PAM sequence: CTG
gctccagaaattacttgtta

SEQ ID NO: 299727 - DNA, 20 bp, Artificial Sequence
  Description of Artificial Sequence: Synthetic oligonucleotide
  Target: ATXN1; (+) strand; PAM type: YTN; PAM sequence: CTC
cagaaattacttgttactta

SEQ ID NO: 299728 - DNA, 20 bp, Artificial Sequence
  Description of Artificial Sequence: Synthetic oligonucleotide
  Target: ATXN1; (+) strand; PAM type: YTN; PAM sequence: TTA
cttgttacttactatgtggg

SEQ ID NO: 299729 - DNA, 20 bp, Artificial Sequence
  Description of Artificial Sequence: Synthetic oligonucleotide
  Target: ATXN1; (+) strand; PAM type: YTN; PAM sequence: CTT
gttacttactatgtgggaag

SEQ ID NO: 299730 - DNA, 20 bp, Artificial Sequence
  Description of Artificial Sequence: Synthetic oligonucleotide
  Target: ATXN1; (+) strand; PAM type: YTN; PAM sequence: TTG
ttacttactatgtgggaagg

SEQ ID NO: 299731 - DNA, 20 bp, Artificial Sequence
  Description of Artificial Sequence: Synthetic oligonucleotide
  Target: ATXN1; (+) strand; PAM type: YTN; PAM sequence: TTA
cttactatgtgggaaggaat

SEQ ID NO: 299732 - DNA, 20 bp, Artificial Sequence
  Description of Artificial Sequence: Synthetic oligonucleotide
  Target: ATXN1; (+) strand; PAM type: YTN; PAM sequence: CTT
actatgtgggaaggaattca

SEQ ID NO: 299733 - DNA, 20 bp, Artificial Sequence
  Description of Artificial Sequence: Synthetic oligonucleotide
  Target: ATXN1; (+) strand; PAM type: YTN; PAM sequence: TTA
ctatgtgggaaggaattcaa

SEQ ID NO: 299734 - DNA, 20 bp, Artificial Sequence
  Description of Artificial Sequence: Synthetic oligonucleotide
  Target: ATXN1; (+) strand; PAM type: YTN; PAM sequence: CTA
tgtgggaaggaattcaaatg

SEQ ID NO: 299735 - DNA, 20 bp, Artificial Sequence
  Description of Artificial Sequence: Synthetic oligonucleotide
  Target: ATXN1; (+) strand; PAM type: YTN; PAM sequence: TTC
aaatgctttcactgttatgt

SEQ ID NO: 299736 - DNA, 20 bp, Artificial Sequence
  Description of Artificial Sequence: Synthetic oligonucleotide
  Target: ATXN1; (+) strand; PAM type: YTN; PAM sequence: CTT
tcactgttatgtcaggtcaa

SEQ ID NO: 299737 - DNA, 20 bp, Artificial Sequence
  Description of Artificial Sequence: Synthetic oligonucleotide
  Target: ATXN1; (+) strand; PAM type: YTN; PAM sequence: TTT
cactgttatgtcaggtcaat

SEQ ID NO: 299738 - DNA, 20 bp, Artificial Sequence
  Description of Artificial Sequence: Synthetic oligonucleotide
  Target: ATXN1; (+) strand; PAM type: YTN; PAM sequence: TTC
actgttatgtcaggtcaatc

SEQ ID NO: 299739 - DNA, 20 bp, Artificial Sequence
  Description of Artificial Sequence: Synthetic oligonucleotide
  Target: ATXN1; (+) strand; PAM type: YTN; PAM sequence: CTG
ttatgtcaggtcaatctgtt

SEQ ID NO: 299740 - DNA, 20 bp, Artificial Sequence
  Description of Artificial Sequence: Synthetic oligonucleotide
  Target: ATXN1; (+) strand; PAM type: YTN; PAM sequence: TTA
tgtcaggtcaatctgttaag

SEQ ID NO: 299741 - DNA, 20 bp, Artificial Sequence
  Description of Artificial Sequence: Synthetic oligonucleotide
  Target: ATXN1; (+) strand; PAM type: YTN; PAM sequence: CTG
ttaagtgtattgtaaatttt

SEQ ID NO: 299742 - DNA, 20 bp, Artificial Sequence
  Description of Artificial Sequence: Synthetic oligonucleotide
  Target: ATXN1; (+) strand; PAM type: YTN; PAM sequence: TTA
agtgtattgtaaatttttgc

SEQ ID NO: 299743 - DNA, 20 bp, Artificial Sequence
  Description of Artificial Sequence: Synthetic oligonucleotide
  Target: ATXN1; (+) strand; PAM type: YTN; PAM sequence: TTG
taaatttttgccacatcagt

SEQ ID NO: 299744 - DNA, 20 bp, Artificial Sequence
  Description of Artificial Sequence: Synthetic oligonucleotide
  Target: ATXN1; (+) strand; PAM type: YTN; PAM sequence: TTT
ttgccacatcagtatcccac

SEQ ID NO: 299745 - DNA, 20 bp, Artificial Sequence
  Description of Artificial Sequence: Synthetic oligonucleotide
  Target: ATXN1; (+) strand; PAM type: YTN; PAM sequence: TTT
tgccacatcagtatcccact

SEQ ID NO: 299746 - DNA, 20 bp, Artificial Sequence
  Description of Artificial Sequence: Synthetic oligonucleotide
  Target: ATXN1; (+) strand; PAM type: YTN; PAM sequence: TTT
gccacatcagtatcccactt

SEQ ID NO: 299747 - DNA, 20 bp, Artificial Sequence
  Description of Artificial Sequence: Synthetic oligonucleotide
  Target: ATXN1; (+) strand; PAM type: YTN; PAM sequence: TTG
ccacatcagtatcccacttt

SEQ ID NO: 299748 - DNA, 20 bp, Artificial Sequence
  Description of Artificial Sequence: Synthetic oligonucleotide
  Target: ATXN1; (+) strand; PAM type: YTN; PAM sequence: CTT
tgatcactaatgccatttgt

SEQ ID NO: 299749 - DNA, 20 bp, Artificial Sequence
  Description of Artificial Sequence: Synthetic oligonucleotide
  Target: ATXN1; (+) strand; PAM type: YTN; PAM sequence: TTT
gatcactaatgccatttgta

SEQ ID NO: 299750 - DNA, 20 bp, Artificial Sequence
  Description of Artificial Sequence: Synthetic oligonucleotide
  Target: ATXN1; (+) strand; PAM type: YTN; PAM sequence: TTG
atcactaatgccatttgtat

SEQ ID NO: 299751 - DNA, 20 bp, Artificial Sequence
  Description of Artificial Sequence: Synthetic oligonucleotide
  Target: ATXN1; (+) strand; PAM type: YTN; PAM sequence: CTA
atgccatttgtatattagct

SEQ ID NO: 299752 - DNA, 20 bp, Artificial Sequence
  Description of Artificial Sequence: Synthetic oligonucleotide
  Target: ATXN1; (+) strand; PAM type: YTN; PAM sequence: TTT
gtatattagcttgtaataca

SEQ ID NO: 299753 - DNA, 20 bp, Artificial Sequence
  Description of Artificial Sequence: Synthetic oligonucleotide
  Target: ATXN1; (+) strand; PAM type: YTN; PAM sequence: TTG
tatattagcttgtaatacac

SEQ ID NO: 299754 - DNA, 20 bp, Artificial Sequence
  Description of Artificial Sequence: Synthetic oligonucleotide
  Target: ATXN1; (+) strand; PAM type: YTN; PAM sequence: TTA
gcttgtaatacacactgatc

SEQ ID NO: 299755 - DNA, 20 bp, Artificial Sequence
  Description of Artificial Sequence: Synthetic oligonucleotide
  Target: ATXN1; (+) strand; PAM type: YTN; PAM sequence: CTT
gtaatacacactgatcataa

SEQ ID NO: 299756 - DNA, 20 bp, Artificial Sequence
  Description of Artificial Sequence: Synthetic oligonucleotide
  Target: ATXN1; (+) strand; PAM type: YTN; PAM sequence: TTG
taatacacactgatcataaa

SEQ ID NO: 299757 - DNA, 20 bp, Artificial Sequence
  Description of Artificial Sequence: Synthetic oligonucleotide
  Target: ATXN1; (+) strand; PAM type: YTN; PAM sequence: CTG
atcataaagcaataaaactg

SEQ ID NO: 299758 - DNA, 20 bp, Artificial Sequence
  Description of Artificial Sequence: Synthetic oligonucleotide
  Target: ATXN1; (+) strand; PAM type: YTN; PAM sequence: CTG
cattttgctaaactttaaaa

SEQ ID NO: 299759 - DNA, 20 bp, Artificial Sequence
  Description of Artificial Sequence: Synthetic oligonucleotide
  Target: ATXN1; (+) strand; PAM type: YTN; PAM sequence: TTT
tgctaaactttaaaaatgaa

SEQ ID NO: 299760 - DNA, 20 bp, Artificial Sequence
  Description of Artificial Sequence: Synthetic oligonucleotide
  Target: ATXN1; (+) strand; PAM type: YTN; PAM sequence: TTT
gctaaactttaaaaatgaag

SEQ ID NO: 299761 - DNA, 20 bp, Artificial Sequence
  Description of Artificial Sequence: Synthetic oligonucleotide
  Target: ATXN1; (+) strand; PAM type: YTN; PAM sequence: TTG
ctaaactttaaaaatgaagg

SEQ ID NO: 299762 - DNA, 20 bp, Artificial Sequence
  Description of Artificial Sequence: Synthetic oligonucleotide
  Target: ATXN1; (+) strand; PAM type: YTN; PAM sequence: CTA
aactttaaaaatgaaggctt

SEQ ID NO: 299763 - DNA, 20 bp, Artificial Sequence
  Description of Artificial Sequence: Synthetic oligonucleotide
  Target: ATXN1; (+) strand; PAM type: YTN; PAM sequence: CTT
taaaaatgaaggcttttgcc

SEQ ID NO: 299764 - DNA, 20 bp, Artificial Sequence
  Description of Artificial Sequence: Synthetic oligonucleotide
  Target: ATXN1; (+) strand; PAM type: YTN; PAM sequence: TTT
aaaaatgaaggcttttgccc

SEQ ID NO: 299765 - DNA, 20 bp, Artificial Sequence
  Description of Artificial Sequence: Synthetic oligonucleotide
  Target: ATXN1; (+) strand; PAM type: YTN; PAM sequence: TTA
aaaatgaaggcttttgccca

SEQ ID NO: 299766 - DNA, 20 bp, Artificial Sequence
  Description of Artificial Sequence: Synthetic oligonucleotide
  Target: ATXN1; (+) strand; PAM type: YTN; PAM sequence: CTT
ttgcccaatgacactgacat

SEQ ID NO: 299767 - DNA, 20 bp, Artificial Sequence
  Description of Artificial Sequence: Synthetic oligonucleotide
  Target: ATXN1; (+) strand; PAM type: YTN; PAM sequence: TTT
tgcccaatgacactgacatc

SEQ ID NO: 299768 - DNA, 20 bp, Artificial Sequence
  Description of Artificial Sequence: Synthetic oligonucleotide
  Target: ATXN1; (+) strand; PAM type: YTN; PAM sequence: TTT
gcccaatgacactgacatcc

SEQ ID NO: 299769 - DNA, 20 bp, Artificial Sequence
  Description of Artificial Sequence: Synthetic oligonucleotide
  Target: ATXN1; (+) strand; PAM type: YTN; PAM sequence: TTG
cccaatgacactgacatcct

SEQ ID NO: 299770 - DNA, 20 bp, Artificial Sequence
  Description of Artificial Sequence: Synthetic oligonucleotide
  Target: ATXN1; (+) strand; PAM type: YTN; PAM sequence: CTG
acatcctcacgccaccacct

SEQ ID NO: 299771 - DNA, 20 bp, Artificial Sequence
  Description of Artificial Sequence: Synthetic oligonucleotide
  Target: ATXN1; (+) strand; PAM type: YTN; PAM sequence: CTC
acgccaccacctccccgccc

SEQ ID NO: 299772 - DNA, 20 bp, Artificial Sequence
  Description of Artificial Sequence: Synthetic oligonucleotide
  Target: ATXN1; (+) strand; PAM type: YTN; PAM sequence: CTC
cccgcccccattattcagaa

SEQ ID NO: 299773 - DNA, 20 bp, Artificial Sequence
  Description of Artificial Sequence: Synthetic oligonucleotide
  Target: ATXN1; (+) strand; PAM type: YTN; PAM sequence: TTA
ttcagaataagtggagtgtg

SEQ ID NO: 299774 - DNA, 20 bp, Artificial Sequence
  Description of Artificial Sequence: Synthetic oligonucleotide
  Target: ATXN1; (+) strand; PAM type: YTN; PAM sequence: TTC
agaataagtggagtgtggag

SEQ ID NO: 299775 - DNA, 20 bp, Artificial Sequence
  Description of Artificial Sequence: Synthetic oligonucleotide
  Target: ATXN1; (+) strand; PAM type: YTN; PAM sequence: TTG
ggttttccctttctggggag

SEQ ID NO: 299776 - DNA, 20 bp, Artificial Sequence
  Description of Artificial Sequence: Synthetic oligonucleotide
  Target: ATXN1; (+) strand; PAM type: YTN; PAM sequence: TTT
tccctttctggggaggaaca

SEQ ID NO: 299777 - DNA, 20 bp, Artificial Sequence
  Description of Artificial Sequence: Synthetic oligonucleotide
  Target: ATXN1; (+) strand; PAM type: YTN; PAM sequence: TTT
ccctttctggggaggaacaa

SEQ ID NO: 299778 - DNA, 20 bp, Artificial Sequence
  Description of Artificial Sequence: Synthetic oligonucleotide
  Target: ATXN1; (+) strand; PAM type: YTN; PAM sequence: TTC
cctttctggggaggaacaaa

SEQ ID NO: 299779 - DNA, 20 bp, Artificial Sequence
  Description of Artificial Sequence: Synthetic oligonucleotide
  Target: ATXN1; (+) strand; PAM type: YTN; PAM sequence: CTT
tctggggaggaacaaatgaa

SEQ ID NO: 299780 - DNA, 20 bp, Artificial Sequence
  Description of Artificial Sequence: Synthetic oligonucleotide
  Target: ATXN1; (+) strand; PAM type: YTN; PAM sequence: TTT
ctggggaggaacaaatgaat

SEQ ID NO: 299781 - DNA, 20 bp, Artificial Sequence
  Description of Artificial Sequence: Synthetic oligonucleotide
  Target: ATXN1; (+) strand; PAM type: YTN; PAM sequence: TTC
tggggaggaacaaatgaatg

SEQ ID NO: 299782 - DNA, 20 bp, Artificial Sequence
  Description of Artificial Sequence: Synthetic oligonucleotide
  Target: ATXN1; (+) strand; PAM type: YTN; PAM sequence: CTG
gggaggaacaaatgaatgag

SEQ ID NO: 299783 - DNA, 20 bp, Artificial Sequence
  Description of Artificial Sequence: Synthetic oligonucleotide
  Target: ATXN1; (+) strand; PAM type: YTN; PAM sequence: CTA
gtgagggcatcttagggagt

SEQ ID NO: 299784 - DNA, 20 bp, Artificial Sequence
  Description of Artificial Sequence: Synthetic oligonucleotide
  Target: ATXN1; (+) strand; PAM type: YTN; PAM sequence: CTT
agggagttcccccgcccaca

SEQ ID NO: 299785 - DNA, 20 bp, Artificial Sequence
  Description of Artificial Sequence: Synthetic oligonucleotide
  Target: ATXN1; (+) strand; PAM type: YTN; PAM sequence: TTA
gggagttcccccgcccacag

SEQ ID NO: 299786 - DNA, 20 bp, Artificial Sequence
  Description of Artificial Sequence: Synthetic oligonucleotide
  Target: ATXN1; (+) strand; PAM type: YTN; PAM sequence: TTC
ccccgcccacagactatgag

SEQ ID NO: 299787 - DNA, 20 bp, Artificial Sequence
  Description of Artificial Sequence: Synthetic oligonucleotide
  Target: ATXN1; (+) strand; PAM type: YTN; PAM sequence: CTA
tgaggcatcttgatttgaaa

SEQ ID NO: 299788 - DNA, 20 bp, Artificial Sequence
  Description of Artificial Sequence: Synthetic oligonucleotide
  Target: ATXN1; (+) strand; PAM type: YTN; PAM sequence: CTT
gatttgaaaggaatacacaa

SEQ ID NO: 299789 - DNA, 20 bp, Artificial Sequence
  Description of Artificial Sequence: Synthetic oligonucleotide
  Target: ATXN1; (+) strand; PAM type: YTN; PAM sequence: TTG
atttgaaaggaatacacaat

SEQ ID NO: 299790 - DNA, 20 bp, Artificial Sequence
  Description of Artificial Sequence: Synthetic oligonucleotide
  Target: ATXN1; (+) strand; PAM type: YTN; PAM sequence: TTT
gaaaggaatacacaatattg

SEQ ID NO: 299791 - DNA, 20 bp, Artificial Sequence
  Description of Artificial Sequence: Synthetic oligonucleotide
  Target: ATXN1; (+) strand; PAM type: YTN; PAM sequence: TTG
aaaggaatacacaatattgc

SEQ ID NO: 299792 - DNA, 20 bp, Artificial Sequence
  Description of Artificial Sequence: Synthetic oligonucleotide
  Target: ATXN1; (+) strand; PAM type: YTN; PAM sequence: TTG
ctgctgcacccacaccacac

SEQ ID NO: 299793 - DNA, 20 bp, Artificial Sequence
  Description of Artificial Sequence: Synthetic oligonucleotide
  Target: ATXN1; (+) strand; PAM type: YTN; PAM sequence: CTG
ctgcacccacaccacacgca

SEQ ID NO: 299794 - DNA, 20 bp, Artificial Sequence
  Description of Artificial Sequence: Synthetic oligonucleotide
  Target: ATXN1; (+) strand; PAM type: YTN; PAM sequence: CTG
cacccacaccacacgcacac

SEQ ID NO: 299795 - DNA, 20 bp, Artificial Sequence
  Description of Artificial Sequence: Synthetic oligonucleotide
  Target: ATXN1; (+) strand; PAM type: YTN; PAM sequence: CTT
ttaaagttgacttcttacat

SEQ ID NO: 299796 - DNA, 20 bp, Artificial Sequence
  Description of Artificial Sequence: Synthetic oligonucleotide
  Target: ATXN1; (+) strand; PAM type: YTN; PAM sequence: TTT
taaagttgacttcttacata

SEQ ID NO: 299797 - DNA, 20 bp, Artificial Sequence
  Description of Artificial Sequence: Synthetic oligonucleotide
  Target: ATXN1; (+) strand; PAM type: YTN; PAM sequence: TTT
aaagttgacttcttacataa

SEQ ID NO: 299798 - DNA, 20 bp, Artificial Sequence
  Description of Artificial Sequence: Synthetic oligonucleotide
  Target: ATXN1; (+) strand; PAM type: YTN; PAM sequence: TTA
aagttgacttcttacataaa

SEQ ID NO: 299799 - DNA, 20 bp, Artificial Sequence
  Description of Artificial Sequence: Synthetic oligonucleotide
  Target: ATXN1; (+) strand; PAM type: YTN; PAM sequence: TTG
acttcttacataaaagccag

SEQ ID NO: 299800 - DNA, 20 bp, Artificial Sequence
  Description of Artificial Sequence: Synthetic oligonucleotide
  Target: ATXN1; (+) strand; PAM type: YTN; PAM sequence: CTT
cttacataaaagccagcagt

SEQ ID NO: 299801 - DNA, 20 bp, Artificial Sequence
  Description of Artificial Sequence: Synthetic oligonucleotide
  Target: ATXN1; (+) strand; PAM type: YTN; PAM sequence: TTC
ttacataaaagccagcagta

SEQ ID NO: 299802 - DNA, 20 bp, Artificial Sequence
  Description of Artificial Sequence: Synthetic oligonucleotide
  Target: ATXN1; (+) strand; PAM type: YTN; PAM sequence: CTT
acataaaagccagcagtact

SEQ ID NO: 299803 - DNA, 20 bp, Artificial Sequence
  Description of Artificial Sequence: Synthetic oligonucleotide
  Target: ATXN1; (+) strand; PAM type: YTN; PAM sequence: TTA
cataaaagccagcagtactc

SEQ ID NO: 299804 - DNA, 20 bp, Artificial Sequence
  Description of Artificial Sequence: Synthetic oligonucleotide
  Target: ATXN1; (+) strand; PAM type: YTN; PAM sequence: CTC
cctgctagaatctgaagaaa

SEQ ID NO: 299805 - DNA, 20 bp, Artificial Sequence
  Description of Artificial Sequence: Synthetic oligonucleotide
  Target: ATXN1; (+) strand; PAM type: YTN; PAM sequence: CTG
ctagaatctgaagaaaagaa

SEQ ID NO: 299806 - DNA, 20 bp, Artificial Sequence
  Description of Artificial Sequence: Synthetic oligonucleotide
  Target: ATXN1; (+) strand; PAM type: YTN; PAM sequence: CTA
gaatctgaagaaaagaatat

SEQ ID NO: 299807 - DNA, 20 bp, Artificial Sequence
  Description of Artificial Sequence: Synthetic oligonucleotide
  Target: ATXN1; (+) strand; PAM type: YTN; PAM sequence: CTG
aagaaaagaatattattatt

SEQ ID NO: 299808 - DNA, 20 bp, Artificial Sequence
  Description of Artificial Sequence: Synthetic oligonucleotide
  Target: ATXN1; (+) strand; PAM type: YTN; PAM sequence: TTA
ttattactattattatttta

SEQ ID NO: 299809 - DNA, 20 bp, Artificial Sequence
  Description of Artificial Sequence: Synthetic oligonucleotide
  Target: ATXN1; (+) strand; PAM type: YTN; PAM sequence: TTA
ttactattattattttactg

SEQ ID NO: 299810 - DNA, 20 bp, Artificial Sequence
  Description of Artificial Sequence: Synthetic oligonucleotide
  Target: ATXN1; (+) strand; PAM type: YTN; PAM sequence: TTA
ctattattattttactggca

SEQ ID NO: 299811 - DNA, 20 bp, Artificial Sequence
  Description of Artificial Sequence: Synthetic oligonucleotide
  Target: ATXN1; (+) strand; PAM type: YTN; PAM sequence: CTA
ttattattttactggcaagg

SEQ ID NO: 299812 - DNA, 20 bp, Artificial Sequence
  Description of Artificial Sequence: Synthetic oligonucleotide
  Target: ATXN1; (+) strand; PAM type: YTN; PAM sequence: TTA
ttattttactggcaaggcct

SEQ ID NO: 299813 - DNA, 20 bp, Artificial Sequence
  Description of Artificial Sequence: Synthetic oligonucleotide
  Target: ATXN1; (+) strand; PAM type: YTN; PAM sequence: TTA
ttttactggcaaggcctttc

SEQ ID NO: 299814 - DNA, 20 bp, Artificial Sequence
  Description of Artificial Sequence: Synthetic oligonucleotide
  Target: ATXN1; (+) strand; PAM type: YTN; PAM sequence: TTT
tactggcaaggcctttcagg

SEQ ID NO: 299815 - DNA, 20 bp, Artificial Sequence
  Description of Artificial Sequence: Synthetic oligonucleotide
  Target: ATXN1; (+) strand; PAM type: YTN; PAM sequence: TTT
actggcaaggcctttcaggg

SEQ ID NO: 299816 - DNA, 20 bp, Artificial Sequence
  Description of Artificial Sequence: Synthetic oligonucleotide
  Target: ATXN1; (+) strand; PAM type: YTN; PAM sequence: TTA
ctggcaaggcctttcagggg

SEQ ID NO: 299817 - DNA, 20 bp, Artificial Sequence
  Description of Artificial Sequence: Synthetic oligonucleotide
  Target: ATXN1; (+) strand; PAM type: YTN; PAM sequence: CTG
gcaaggcctttcagggggtt

SEQ ID NO: 299818 - DNA, 20 bp, Artificial Sequence
  Description of Artificial Sequence: Synthetic oligonucleotide
  Target: ATXN1; (+) strand; PAM type: YTN; PAM sequence: CTT
tcagggggttatgcttcatt

SEQ ID NO: 299819 - DNA, 20 bp, Artificial Sequence
  Description of Artificial Sequence: Synthetic oligonucleotide
  Target: ATXN1; (+) strand; PAM type: YTN; PAM sequence: TTT
cagggggttatgcttcattc

SEQ ID NO: 299820 - DNA, 20 bp, Artificial Sequence
  Description of Artificial Sequence: Synthetic oligonucleotide
  Target: ATXN1; (+) strand; PAM type: YTN; PAM sequence: TTC
agggggttatgcttcattca

SEQ ID NO: 299821 - DNA, 20 bp, Artificial Sequence
  Description of Artificial Sequence: Synthetic oligonucleotide
  Target: ATXN1; (+) strand; PAM type: YTN; PAM sequence: TTA
tgcttcattcaattgagcct

SEQ ID NO: 299822 - DNA, 20 bp, Artificial Sequence
  Description of Artificial Sequence: Synthetic oligonucleotide
  Target: ATXN1; (+) strand; PAM type: YTN; PAM sequence: CTT
cattcaattgagcctaattg

SEQ ID NO: 299823 - DNA, 20 bp, Artificial Sequence
  Description of Artificial Sequence: Synthetic oligonucleotide
  Target: ATXN1; (+) strand; PAM type: YTN; PAM sequence: TTC
attcaattgagcctaattga

SEQ ID NO: 299824 - DNA, 20 bp, Artificial Sequence
  Description of Artificial Sequence: Synthetic oligonucleotide
  Target: ATXN1; (+) strand; PAM type: YTN; PAM sequence: TTC
aattgagcctaattgataaa

SEQ ID NO: 299825 - DNA, 20 bp, Artificial Sequence
  Description of Artificial Sequence: Synthetic oligonucleotide
  Target: ATXN1; (+) strand; PAM type: YTN; PAM sequence: TTG
agcctaattgataaagctaa

SEQ ID NO: 299826 - DNA, 20 bp, Artificial Sequence
  Description of Artificial Sequence: Synthetic oligonucleotide
  Target: ATXN1; (+) strand; PAM type: YTN; PAM sequence: CTA
attgataaagctaacacatg

SEQ ID NO: 299827 - DNA, 20 bp, Artificial Sequence
  Description of Artificial Sequence: Synthetic oligonucleotide
  Target: ATXN1; (+) strand; PAM type: YTN; PAM sequence: TTG
ataaagctaacacatgttta

SEQ ID NO: 299828 - DNA, 20 bp, Artificial Sequence
  Description of Artificial Sequence: Synthetic oligonucleotide
  Target: ATXN1; (+) strand; PAM type: YTN; PAM sequence: CTA
acacatgtttacaggtaata

SEQ ID NO: 299829 - DNA, 20 bp, Artificial Sequence
  Description of Artificial Sequence: Synthetic oligonucleotide
  Target: ATXN1; (+) strand; PAM type: YTN; PAM sequence: TTT
acaggtaataaaaatgaagt

SEQ ID NO: 299830 - DNA, 20 bp, Artificial Sequence
  Description of Artificial Sequence: Synthetic oligonucleotide
  Target: ATXN1; (+) strand; PAM type: YTN; PAM sequence: TTA
caggtaataaaaatgaagta

SEQ ID NO: 299831 - DNA, 20 bp, Artificial Sequence
  Description of Artificial Sequence: Synthetic oligonucleotide
  Target: ATXN1; (+) strand; PAM type: YTN; PAM sequence: CTA
tctacatggaaacaaatcag

SEQ ID NO: 299832 - DNA, 20 bp, Artificial Sequence
  Description of Artificial Sequence: Synthetic oligonucleotide
  Target: ATXN1; (+) strand; PAM type: YTN; PAM sequence: CTA
catggaaacaaatcagggag

SEQ ID NO: 299833 - DNA, 20 bp, Artificial Sequence
  Description of Artificial Sequence: Synthetic oligonucleotide
  Target: ATXN1; (+) strand; PAM type: YTN; PAM sequence: TTA
ttcattctttaaactgtaaa

SEQ ID NO: 299834 - DNA, 20 bp, Artificial Sequence
  Description of Artificial Sequence: Synthetic oligonucleotide
  Target: ATXN1; (+) strand; PAM type: YTN; PAM sequence: TTC
attctttaaactgtaaaaac

SEQ ID NO: 299835 - DNA, 20 bp, Artificial Sequence
  Description of Artificial Sequence: Synthetic oligonucleotide
  Target: ATXN1; (+) strand; PAM type: YTN; PAM sequence: TTC
tttaaactgtaaaaactaaa

SEQ ID NO: 299836 - DNA, 20 bp, Artificial Sequence
  Description of Artificial Sequence: Synthetic oligonucleotide
  Target: ATXN1; (+) strand; PAM type: YTN; PAM sequence: CTT
taaactgtaaaaactaaaat

SEQ ID NO: 299837 - DNA, 20 bp, Artificial Sequence
  Description of Artificial Sequence: Synthetic oligonucleotide
  Target: ATXN1; (+) strand; PAM type: YTN; PAM sequence: TTT
aaactgtaaaaactaaaatg

SEQ ID NO: 299838 - DNA, 20 bp, Artificial Sequence
  Description of Artificial Sequence: Synthetic oligonucleotide
  Target: ATXN1; (+) strand; PAM type: YTN; PAM sequence: TTA
aactgtaaaaactaaaatgt

SEQ ID NO: 299839 - DNA, 20 bp, Artificial Sequence
  Description of Artificial Sequence: Synthetic oligonucleotide
  Target: ATXN1; (+) strand; PAM type: YTN; PAM sequence: CTG
taaaaactaaaatgttctct

SEQ ID NO: 299840 - DNA, 20 bp, Artificial Sequence
  Description of Artificial Sequence: Synthetic oligonucleotide
  Target: ATXN1; (+) strand; PAM type: YTN; PAM sequence: CTA
aaatgttctctaagcattat

SEQ ID NO: 299841 - DNA, 20 bp, Artificial Sequence
  Description of Artificial Sequence: Synthetic oligonucleotide
  Target: ATXN1; (+) strand; PAM type: YTN; PAM sequence: TTC
tctaagcattatcaagtcct

SEQ ID NO: 299842 - DNA, 20 bp, Artificial Sequence
  Description of Artificial Sequence: Synthetic oligonucleotide
  Target: ATXN1; (+) strand; PAM type: YTN; PAM sequence: CTC
taagcattatcaagtcctaa

SEQ ID NO: 299843 - DNA, 20 bp, Artificial Sequence
  Description of Artificial Sequence: Synthetic oligonucleotide
  Target: ATXN1; (+) strand; PAM type: YTN; PAM sequence: CTA
agcattatcaagtcctaaac

SEQ ID NO: 299844 - DNA, 20 bp, Artificial Sequence
  Description of Artificial Sequence: Synthetic oligonucleotide
  Target: ATXN1; (+) strand; PAM type: YTN; PAM sequence: TTA
tcaagtcctaaacaaaaata

SEQ ID NO: 299845 - DNA, 20 bp, Artificial Sequence
  Description of Artificial Sequence: Synthetic oligonucleotide
  Target: ATXN1; (+) strand; PAM type: YTN; PAM sequence: CTA
aacaaaaatataatttcaca

SEQ ID NO: 299846 - DNA, 20 bp, Artificial Sequence
  Description of Artificial Sequence: Synthetic oligonucleotide
  Target: ATXN1; (+) strand; PAM type: YTN; PAM sequence: TTT
cacaaagcaaagacattcat

SEQ ID NO: 299847 - DNA, 20 bp, Artificial Sequence
  Description of Artificial Sequence: Synthetic oligonucleotide
  Target: ATXN1; (+) strand; PAM type: YTN; PAM sequence: TTC
acaaagcaaagacattcatt

SEQ ID NO: 299848 - DNA, 20 bp, Artificial Sequence
  Description of Artificial Sequence: Synthetic oligonucleotide
  Target: ATXN1; (+) strand; PAM type: YTN; PAM sequence: TTC
attttatcgttcaataaatt

SEQ ID NO: 299849 - DNA, 20 bp, Artificial Sequence
  Description of Artificial Sequence: Synthetic oligonucleotide
  Target: ATXN1; (+) strand; PAM type: YTN; PAM sequence: TTT
tatcgttcaataaattattt

SEQ ID NO: 299850 - DNA, 20 bp, Artificial Sequence
  Description of Artificial Sequence: Synthetic oligonucleotide
  Target: ATXN1; (+) strand; PAM type: YTN; PAM sequence: TTT
atcgttcaataaattatttt

SEQ ID NO: 299851 - DNA, 20 bp, Artificial Sequence
  Description of Artificial Sequence: Synthetic oligonucleotide
  Target: ATXN1; (+) strand; PAM type: YTN; PAM sequence: TTA
tcgttcaataaattatttta

SEQ ID NO: 299852 - DNA, 20 bp, Artificial Sequence
  Description of Artificial Sequence: Synthetic oligonucleotide
  Target: ATXN1; (+) strand; PAM type: YTN; PAM sequence: TTC
aataaattattttaagagca

SEQ ID NO: 299853 - DNA, 20 bp, Artificial Sequence
  Description of Artificial Sequence: Synthetic oligonucleotide
  Target: ATXN1; (+) strand; PAM type: YTN; PAM sequence: TTA
ttttaagagcagaaagcact

SEQ ID NO: 299854 - DNA, 20 bp, Artificial Sequence
  Description of Artificial Sequence: Synthetic oligonucleotide
  Target: ATXN1; (+) strand; PAM type: YTN; PAM sequence: TTT
taagagcagaaagcactgac

SEQ ID NO: 299855 - DNA, 20 bp, Artificial Sequence
  Description of Artificial Sequence: Synthetic oligonucleotide
  Target: ATXN1; (+) strand; PAM type: YTN; PAM sequence: TTT
aagagcagaaagcactgact

SEQ ID NO: 299856 - DNA, 20 bp, Artificial Sequence
  Description of Artificial Sequence: Synthetic oligonucleotide
  Target: ATXN1; (+) strand; PAM type: YTN; PAM sequence: TTA
agagcagaaagcactgactt

SEQ ID NO: 299857 - DNA, 20 bp, Artificial Sequence
  Description of Artificial Sequence: Synthetic oligonucleotide
  Target: ATXN1; (+) strand; PAM type: YTN; PAM sequence: CTG
actttagctttactggtata

SEQ ID NO: 299858 - DNA, 20 bp, Artificial Sequence
  Description of Artificial Sequence: Synthetic oligonucleotide
  Target: ATXN1; (+) strand; PAM type: YTN; PAM sequence: CTT
tagctttactggtatattta

SEQ ID NO: 299859 - DNA, 20 bp, Artificial Sequence
  Description of Artificial Sequence: Synthetic oligonucleotide
  Target: ATXN1; (+) strand; PAM type: YTN; PAM sequence: TTT
agctttactggtatatttat

SEQ ID NO: 299860 - DNA, 20 bp, Artificial Sequence
  Description of Artificial Sequence: Synthetic oligonucleotide
  Target: ATXN1; (+) strand; PAM type: YTN; PAM sequence: TTA
gctttactggtatatttatt

SEQ ID NO: 299861 - DNA, 20 bp, Artificial Sequence
  Description of Artificial Sequence: Synthetic oligonucleotide
  Target: ATXN1; (+) strand; PAM type: YTN; PAM sequence: CTT
tactggtatatttatttgtt

SEQ ID NO: 299862 - DNA, 20 bp, Artificial Sequence
  Description of Artificial Sequence: Synthetic oligonucleotide
  Target: ATXN1; (+) strand; PAM type: YTN; PAM sequence: TTT
actggtatatttatttgtta

SEQ ID NO: 299863 - DNA, 20 bp, Artificial Sequence
  Description of Artificial Sequence: Synthetic oligonucleotide
  Target: ATXN1; (+) strand; PAM type: YTN; PAM sequence: TTA
ctggtatatttatttgttat

SEQ ID NO: 299864 - DNA, 20 bp, Artificial Sequence
  Description of Artificial Sequence: Synthetic oligonucleotide
  Target: ATXN1; (+) strand; PAM type: YTN; PAM sequence: CTG
gtatatttatttgttatctc

SEQ ID NO: 299865 - DNA, 20 bp, Artificial Sequence
  Description of Artificial Sequence: Synthetic oligonucleotide
  Target: ATXN1; (+) strand; PAM type: YTN; PAM sequence: TTT
atttgttatctctgttctta

SEQ ID NO: 299866 - DNA, 20 bp, Artificial Sequence
  Description of Artificial Sequence: Synthetic oligonucleotide
  Target: ATXN1; (+) strand; PAM type: YTN; PAM sequence: TTA
tttgttatctctgttcttaa

SEQ ID NO: 299867 - DNA, 20 bp, Artificial Sequence
  Description of Artificial Sequence: Synthetic oligonucleotide
  Target: ATXN1; (+) strand; PAM type: YTN; PAM sequence: TTT
gttatctctgttcttaaaaa

SEQ ID NO: 299868 - DNA, 20 bp, Artificial Sequence
  Description of Artificial Sequence: Synthetic oligonucleotide
  Target: ATXN1; (+) strand; PAM type: YTN; PAM sequence: TTG
ttatctctgttcttaaaaat

SEQ ID NO: 299869 - DNA, 20 bp, Artificial Sequence
  Description of Artificial Sequence: Synthetic oligonucleotide
  Target: ATXN1; (+) strand; PAM type: YTN; PAM sequence: TTA
tctctgttcttaaaaatgga

SEQ ID NO: 299870 - DNA, 20 bp, Artificial Sequence
  Description of Artificial Sequence: Synthetic oligonucleotide
  Target: ATXN1; (+) strand; PAM type: YTN; PAM sequence: CTC
tgttcttaaaaatggaatat

SEQ ID NO: 299871 - DNA, 20 bp, Artificial Sequence
  Description of Artificial Sequence: Synthetic oligonucleotide
  Target: ATXN1; (+) strand; PAM type: YTN; PAM sequence: CTG
ttcttaaaaatggaatattt

SEQ ID NO: 299872 - DNA, 20 bp, Artificial Sequence
  Description of Artificial Sequence: Synthetic oligonucleotide
  Target: ATXN1; (+) strand; PAM type: YTN; PAM sequence: TTC
ttaaaaatggaatatttcca

SEQ ID NO: 299873 - DNA, 20 bp, Artificial Sequence
  Description of Artificial Sequence: Synthetic oligonucleotide
  Target: ATXN1; (+) strand; PAM type: YTN; PAM sequence: CTT
aaaaatggaatatttccagg

SEQ ID NO: 299874 - DNA, 20 bp, Artificial Sequence
  Description of Artificial Sequence: Synthetic oligonucleotide
  Target: ATXN1; (+) strand; PAM type: YTN; PAM sequence: TTA
aaaatggaatatttccaggg

SEQ ID NO: 299875 - DNA, 20 bp, Artificial Sequence
  Description of Artificial Sequence: Synthetic oligonucleotide
  Target: ATXN1; (+) strand; PAM type: YTN; PAM sequence: TTT
ccagggacaaaaagtataag

SEQ ID NO: 299876 - DNA, 20 bp, Artificial Sequence
  Description of Artificial Sequence: Synthetic oligonucleotide
  Target: ATXN1; (+) strand; PAM type: YTN; PAM sequence: TTC
cagggacaaaaagtataagt

SEQ ID NO: 299877 - DNA, 20 bp, Artificial Sequence
  Description of Artificial Sequence: Synthetic oligonucleotide
  Target: ATXN1; (+) strand; PAM type: YTN; PAM sequence: TTA
atatggtttcatatatttta

SEQ ID NO: 299878 - DNA, 20 bp, Artificial Sequence
  Description of Artificial Sequence: Synthetic oligonucleotide
  Target: ATXN1; (+) strand; PAM type: YTN; PAM sequence: TTT
catatattttaaaaatatct

SEQ ID NO: 299879 - DNA, 20 bp, Artificial Sequence
  Description of Artificial Sequence: Synthetic oligonucleotide
  Target: ATXN1; (+) strand; PAM type: YTN; PAM sequence: TTC
atatattttaaaaatatctg

SEQ ID NO: 299880 - DNA, 20 bp, Artificial Sequence
  Description of Artificial Sequence: Synthetic oligonucleotide
  Target: ATXN1; (+) strand; PAM type: YTN; PAM sequence: TTT
taaaaatatctgacatttaa

SEQ ID NO: 299881 - DNA, 20 bp, Artificial Sequence
  Description of Artificial Sequence: Synthetic oligonucleotide
  Target: ATXN1; (+) strand; PAM type: YTN; PAM sequence: TTT
aaaaatatctgacatttaaa

SEQ ID NO: 299882 - DNA, 20 bp, Artificial Sequence
  Description of Artificial Sequence: Synthetic oligonucleotide
  Target: ATXN1; (+) strand; PAM type: YTN; PAM sequence: TTA
aaaatatctgacatttaaaa

SEQ ID NO: 299883 - DNA, 20 bp, Artificial Sequence
  Description of Artificial Sequence: Synthetic oligonucleotide
  Target: ATXN1; (+) strand; PAM type: YTN; PAM sequence: CTG
acatttaaaacaatatctta

SEQ ID NO: 299884 - DNA, 20 bp, Artificial Sequence
  Description of Artificial Sequence: Synthetic oligonucleotide
  Target: ATXN1; (+) strand; PAM type: YTN; PAM sequence: TTT
aaaacaatatcttaataccg

SEQ ID NO: 299885 - DNA, 20 bp, Artificial Sequence
  Description of Artificial Sequence: Synthetic oligonucleotide
  Target: ATXN1; (+) strand; PAM type: YTN; PAM sequence: TTA
aaacaatatcttaataccga

SEQ ID NO: 299886 - DNA, 20 bp, Artificial Sequence
  Description of Artificial Sequence: Synthetic oligonucleotide
  Target: ATXN1; (+) strand; PAM type: YTN; PAM sequence: CTT
aataccgaatattcttaatg

SEQ ID NO: 299887 - DNA, 20 bp, Artificial Sequence
  Description of Artificial Sequence: Synthetic oligonucleotide
  Target: ATXN1; (+) strand; PAM type: YTN; PAM sequence: TTA
ataccgaatattcttaatga

SEQ ID NO: 299888 - DNA, 20 bp, Artificial Sequence
  Description of Artificial Sequence: Synthetic oligonucleotide
  Target: ATXN1; (+) strand; PAM type: YTN; PAM sequence: TTC
ttaatgaaaagttctgtttt

SEQ ID NO: 299889 - DNA, 20 bp, Artificial Sequence
  Description of Artificial Sequence: Synthetic oligonucleotide
  Target: ATXN1; (+) strand; PAM type: YTN; PAM sequence: CTT
aatgaaaagttctgtttttt

SEQ ID NO: 299890 - DNA, 20 bp, Artificial Sequence
  Description of Artificial Sequence: Synthetic oligonucleotide
  Target: ATXN1; (+) strand; PAM type: YTN; PAM sequence: TTA
atgaaaagttctgttttttt

SEQ ID NO: 299891 - DNA, 20 bp, Artificial Sequence
  Description of Artificial Sequence: Synthetic oligonucleotide
  Target: ATXN1; (+) strand; PAM type: YTN; PAM sequence: TTC
tgttttttttgaaaagtcct

SEQ ID NO: 299892 - DNA, 20 bp, Artificial Sequence
  Description of Artificial Sequence: Synthetic oligonucleotide
  Target: ATXN1; (+) strand; PAM type: YTN; PAM sequence: CTG
ttttttttgaaaagtcctcc

SEQ ID NO: 299893 - DNA, 20 bp, Artificial Sequence
  Description of Artificial Sequence: Synthetic oligonucleotide
  Target: ATXN1; (+) strand; PAM type: YTN; PAM sequence: TTT
tttttgaaaagtcctccata

SEQ ID NO: 299894 - DNA, 20 bp, Artificial Sequence
  Description of Artificial Sequence: Synthetic oligonucleotide
  Target: ATXN1; (+) strand; PAM type: YTN; PAM sequence: TTT
ttttgaaaagtcctccatac

SEQ ID NO: 299895 - DNA, 20 bp, Artificial Sequence
  Description of Artificial Sequence: Synthetic oligonucleotide
  Target: ATXN1; (+) strand; PAM type: YTN; PAM sequence: TTT
tttgaaaagtcctccataca

SEQ ID NO: 299896 - DNA, 20 bp, Artificial Sequence
  Description of Artificial Sequence: Synthetic oligonucleotide
  Target: ATXN1; (+) strand; PAM type: YTN; PAM sequence: TTT
ttgaaaagtcctccatacat

SEQ ID NO: 299897 - DNA, 20 bp, Artificial Sequence
  Description of Artificial Sequence: Synthetic oligonucleotide
  Target: ATXN1; (+) strand; PAM type: YTN; PAM sequence: TTT
tgaaaagtcctccatacata

SEQ ID NO: 299898 - DNA, 20 bp, Artificial Sequence
  Description of Artificial Sequence: Synthetic oligonucleotide
  Target: ATXN1; (+) strand; PAM type: YTN; PAM sequence: TTT
gaaaagtcctccatacatac

SEQ ID NO: 299899 - DNA, 20 bp, Artificial Sequence
  Description of Artificial Sequence: Synthetic oligonucleotide
  Target: ATXN1; (+) strand; PAM type: YTN; PAM sequence: TTG
aaaagtcctccatacataca

SEQ ID NO: 299900 - DNA, 20 bp, Artificial Sequence
  Description of Artificial Sequence: Synthetic oligonucleotide
  Target: ATXN1; (+) strand; PAM type: YTN; PAM sequence: CTC
catacatacatgtcaattca

SEQ ID NO: 299901 - DNA, 20 bp, Artificial Sequence
  Description of Artificial Sequence: Synthetic oligonucleotide
  Target: ATXN1; (+) strand; PAM type: YTN; PAM sequence: TTC
acaaaaatgcaaattctaaa

SEQ ID NO: 299902 - DNA, 20 bp, Artificial Sequence
  Description of Artificial Sequence: Synthetic oligonucleotide
  Target: ATXN1; (+) strand; PAM type: YTN; PAM sequence: TTC
taaaaattactcaaaatgca

SEQ ID NO: 299903 - DNA, 20 bp, Artificial Sequence
  Description of Artificial Sequence: Synthetic oligonucleotide
  Target: ATXN1; (+) strand; PAM type: YTN; PAM sequence: CTA
aaaattactcaaaatgcatt

SEQ ID NO: 299904 - DNA, 20 bp, Artificial Sequence
  Description of Artificial Sequence: Synthetic oligonucleotide
  Target: ATXN1; (+) strand; PAM type: YTN; PAM sequence: TTA
ctcaaaatgcattgtctttt

SEQ ID NO: 299905 - DNA, 20 bp, Artificial Sequence
  Description of Artificial Sequence: Synthetic oligonucleotide
  Target: ATXN1; (+) strand; PAM type: YTN; PAM sequence: CTC
aaaatgcattgtcttttcgc

SEQ ID NO: 299906 - DNA, 20 bp, Artificial Sequence
  Description of Artificial Sequence: Synthetic oligonucleotide
  Target: ATXN1; (+) strand; PAM type: YTN; PAM sequence: TTG
tcttttcgcttcctgatact

SEQ ID NO: 299907 - DNA, 20 bp, Artificial Sequence
  Description of Artificial Sequence: Synthetic oligonucleotide
  Target: ATXN1; (+) strand; PAM type: YTN; PAM sequence: CTT
ttcgcttcctgatactatat

SEQ ID NO: 299908 - DNA, 20 bp, Artificial Sequence
  Description of Artificial Sequence: Synthetic oligonucleotide
  Target: ATXN1; (+) strand; PAM type: YTN; PAM sequence: TTT
tcgcttcctgatactatatt

SEQ ID NO: 299909 - DNA, 20 bp, Artificial Sequence
  Description of Artificial Sequence: Synthetic oligonucleotide
  Target: ATXN1; (+) strand; PAM type: YTN; PAM sequence: TTT
cgcttcctgatactatattt

SEQ ID NO: 299910 - DNA, 20 bp, Artificial Sequence
  Description of Artificial Sequence: Synthetic oligonucleotide
  Target: ATXN1; (+) strand; PAM type: YTN; PAM sequence: TTC
gcttcctgatactatatttt

SEQ ID NO: 299911 - DNA, 20 bp, Artificial Sequence
  Description of Artificial Sequence: Synthetic oligonucleotide
  Target: ATXN1; (+) strand; PAM type: YTN; PAM sequence: CTT
cctgatactatattttgcag

SEQ ID NO: 299912 - DNA, 20 bp, Artificial Sequence
  Description of Artificial Sequence: Synthetic oligonucleotide
  Target: ATXN1; (+) strand; PAM type: YTN; PAM sequence: TTC
ctgatactatattttgcagt

SEQ ID NO: 299913 - DNA, 20 bp, Artificial Sequence
  Description of Artificial Sequence: Synthetic oligonucleotide
  Target: ATXN1; (+) strand; PAM type: YTN; PAM sequence: CTG
atactatattttgcagtgca

SEQ ID NO: 299914 - DNA, 20 bp, Artificial Sequence
  Description of Artificial Sequence: Synthetic oligonucleotide
  Target: ATXN1; (+) strand; PAM type: YTN; PAM sequence: CTA
tattttgcagtgcatggtgg

SEQ ID NO: 299915 - DNA, 20 bp, Artificial Sequence
  Description of Artificial Sequence: Synthetic oligonucleotide
  Target: ATXN1; (+) strand; PAM type: YTN; PAM sequence: TTT
tgcagtgcatggtggcaaag

SEQ ID NO: 299916 - DNA, 20 bp, Artificial Sequence
  Description of Artificial Sequence: Synthetic oligonucleotide
  Target: ATXN1; (+) strand; PAM type: YTN; PAM sequence: TTT
gcagtgcatggtggcaaagg

SEQ ID NO: 299917 - DNA, 20 bp, Artificial Sequence
  Description of Artificial Sequence: Synthetic oligonucleotide
  Target: ATXN1; (+) strand; PAM type: YTN; PAM sequence: TTG
cagtgcatggtggcaaaggc

SEQ ID NO: 299918 - DNA, 20 bp, Artificial Sequence
  Description of Artificial Sequence: Synthetic oligonucleotide
  Target: ATXN1; (+) strand; PAM type: YTN; PAM sequence: TTT
ttggtaataccttgttacac

SEQ ID NO: 299919 - DNA, 20 bp, Artificial Sequence
  Description of Artificial Sequence: Synthetic oligonucleotide
  Target: ATXN1; (+) strand; PAM type: YTN; PAM sequence: TTT
tggtaataccttgttacaca

SEQ ID NO: 299920 - DNA, 20 bp, Artificial Sequence
  Description of Artificial Sequence: Synthetic oligonucleotide
  Target: ATXN1; (+) strand; PAM type: YTN; PAM sequence: TTT
ggtaataccttgttacacag

SEQ ID NO: 299921 - DNA, 20 bp, Artificial Sequence
  Description of Artificial Sequence: Synthetic oligonucleotide
  Target: ATXN1; (+) strand; PAM type: YTN; PAM sequence: TTG
gtaataccttgttacacaga

SEQ ID NO: 299922 - DNA, 20 bp, Artificial Sequence
  Description of Artificial Sequence: Synthetic oligonucleotide
  Target: ATXN1; (+) strand; PAM type: YTN; PAM sequence: CTT
gttacacagattatttatag

SEQ ID NO: 299923 - DNA, 20 bp, Artificial Sequence
  Description of Artificial Sequence: Synthetic oligonucleotide
  Target: ATXN1; (+) strand; PAM type: YTN; PAM sequence: TTG
ttacacagattatttatagt

SEQ ID NO: 299924 - DNA, 20 bp, Artificial Sequence
  Description of Artificial Sequence: Synthetic oligonucleotide
  Target: ATXN1; (+) strand; PAM type: YTN; PAM sequence: TTA
cacagattatttatagtcat

SEQ ID NO: 299925 - DNA, 20 bp, Artificial Sequence
  Description of Artificial Sequence: Synthetic oligonucleotide
  Target: ATXN1; (+) strand; PAM type: YTN; PAM sequence: TTA
tttatagtcatcccaaaaca

SEQ ID NO: 299926 - DNA, 20 bp, Artificial Sequence
  Description of Artificial Sequence: Synthetic oligonucleotide
  Target: ATXN1; (+) strand; PAM type: YTN; PAM sequence: TTT
atagtcatcccaaaacatac

SEQ ID NO: 299927 - DNA, 20 bp, Artificial Sequence
  Description of Artificial Sequence: Synthetic oligonucleotide
  Target: ATXN1; (+) strand; PAM type: YTN; PAM sequence: TTA
tagtcatcccaaaacataca

SEQ ID NO: 299928 - DNA, 20 bp, Artificial Sequence
  Description of Artificial Sequence: Synthetic oligonucleotide
  Target: ATXN1; (+) strand; PAM type: YTN; PAM sequence: CTT
aaattttaaaaccatatcag

SEQ ID NO: 299929 - DNA, 20 bp, Artificial Sequence
  Description of Artificial Sequence: Synthetic oligonucleotide
  Target: ATXN1; (+) strand; PAM type: YTN; PAM sequence: TTA
aattttaaaaccatatcaga

SEQ ID NO: 299930 - DNA, 20 bp, Artificial Sequence
  Description of Artificial Sequence: Synthetic oligonucleotide
  Target: ATXN1; (+) strand; PAM type: YTN; PAM sequence: TTT
taaaaccatatcagatacta

SEQ ID NO: 299931 - DNA, 20 bp, Artificial Sequence
  Description of Artificial Sequence: Synthetic oligonucleotide
  Target: ATXN1; (+) strand; PAM type: YTN; PAM sequence: TTT
aaaaccatatcagatactaa

SEQ ID NO: 299932 - DNA, 20 bp, Artificial Sequence
  Description of Artificial Sequence: Synthetic oligonucleotide
  Target: ATXN1; (+) strand; PAM type: YTN; PAM sequence: TTA
aaaccatatcagatactaaa

SEQ ID NO: 299933 - DNA, 20 bp, Artificial Sequence
  Description of Artificial Sequence: Synthetic oligonucleotide
  Target: ATXN1; (+) strand; PAM type: YTN; PAM sequence: CTA
aaatatacaacttatccttc

SEQ ID NO: 299934 - DNA, 20 bp, Artificial Sequence
  Description of Artificial Sequence: Synthetic oligonucleotide
  Target: ATXN1; (+) strand; PAM type: YTN; PAM sequence: CTT
atccttccaggtctttccta

SEQ ID NO: 299935 - DNA, 20 bp, Artificial Sequence
  Description of Artificial Sequence: Synthetic oligonucleotide
  Target: ATXN1; (+) strand; PAM type: YTN; PAM sequence: TTA
tccttccaggtctttcctaa

SEQ ID NO: 299936 - DNA, 20 bp, Artificial Sequence
  Description of Artificial Sequence: Synthetic oligonucleotide
  Target: ATXN1; (+) strand; PAM type: YTN; PAM sequence: CTT
ccaggtctttcctaaaaggt

SEQ ID NO: 299937 - DNA, 20 bp, Artificial Sequence
  Description of Artificial Sequence: Synthetic oligonucleotide
  Target: ATXN1; (+) strand; PAM type: YTN; PAM sequence: TTC
caggtctttcctaaaaggta

SEQ ID NO: 299938 - DNA, 20 bp, Artificial Sequence
  Description of Artificial Sequence: Synthetic oligonucleotide
  Target: ATXN1; (+) strand; PAM type: YTN; PAM sequence: CTT
tcctaaaaggtatacataca

SEQ ID NO: 299939 - DNA, 20 bp, Artificial Sequence
  Description of Artificial Sequence: Synthetic oligonucleotide
  Target: ATXN1; (+) strand; PAM type: YTN; PAM sequence: TTT
cctaaaaggtatacatacac

SEQ ID NO: 299940 - DNA, 20 bp, Artificial Sequence
  Description of Artificial Sequence: Synthetic oligonucleotide
  Target: ATXN1; (+) strand; PAM type: YTN; PAM sequence: TTC
ctaaaaggtatacatacact

SEQ ID NO: 299941 - DNA, 20 bp, Artificial Sequence
  Description of Artificial Sequence: Synthetic oligonucleotide
  Target: ATXN1; (+) strand; PAM type: YTN; PAM sequence: CTA
aaaggtatacatacacttcc

SEQ ID NO: 299942 - DNA, 20 bp, Artificial Sequence
  Description of Artificial Sequence: Synthetic oligonucleotide
  Target: ATXN1; (+) strand; PAM type: YTN; PAM sequence: CTT
ccgaagtagtataaaaaaaa

SEQ ID NO: 299943 - DNA, 20 bp, Artificial Sequence
  Description of Artificial Sequence: Synthetic oligonucleotide
  Target: ATXN1; (+) strand; PAM type: YTN; PAM sequence: TTC
cgaagtagtataaaaaaaag

SEQ ID NO: 299944 - DNA, 20 bp, Artificial Sequence
  Description of Artificial Sequence: Synthetic oligonucleotide
  Target: ATXN1; (+) strand; PAM type: YTN; PAM sequence: TTT
caaatctgataacgcactgt

SEQ ID NO: 299945 - DNA, 20 bp, Artificial Sequence
  Description of Artificial Sequence: Synthetic oligonucleotide
  Target: ATXN1; (+) strand; PAM type: YTN; PAM sequence: TTC
aaatctgataacgcactgtg

SEQ ID NO: 299946 - DNA, 20 bp, Artificial Sequence
  Description of Artificial Sequence: Synthetic oligonucleotide
  Target: ATXN1; (+) strand; PAM type: YTN; PAM sequence: CTG
ataacgcactgtgaattagt

SEQ ID NO: 299947 - DNA, 20 bp, Artificial Sequence
  Description of Artificial Sequence: Synthetic oligonucleotide
  Target: ATXN1; (+) strand; PAM type: YTN; PAM sequence: CTG
tgaattagtgaattatctta

SEQ ID NO: 299948 - DNA, 20 bp, Artificial Sequence
  Description of Artificial Sequence: Synthetic oligonucleotide
  Target: ATXN1; (+) strand; PAM type: YTN; PAM sequence: TTA
gtgaattatcttaacaacac

SEQ ID NO: 299949 - DNA, 20 bp, Artificial Sequence
  Description of Artificial Sequence: Synthetic oligonucleotide
  Target: ATXN1; (+) strand; PAM type: YTN; PAM sequence: TTA
tcttaacaacactgtcctaa

SEQ ID NO: 299950 - DNA, 20 bp, Artificial Sequence
  Description of Artificial Sequence: Synthetic oligonucleotide
  Target: ATXN1; (+) strand; PAM type: YTN; PAM sequence: CTT
aacaacactgtcctaattaa

SEQ ID NO: 299951 - DNA, 20 bp, Artificial Sequence
  Description of Artificial Sequence: Synthetic oligonucleotide
  Target: ATXN1; (+) strand; PAM type: YTN; PAM sequence: TTA
acaacactgtcctaattaag

SEQ ID NO: 299952 - DNA, 20 bp, Artificial Sequence
  Description of Artificial Sequence: Synthetic oligonucleotide
  Target: ATXN1; (+) strand; PAM type: YTN; PAM sequence: CTG
tcctaattaagaccaataag

SEQ ID NO: 299953 - DNA, 20 bp, Artificial Sequence
  Description of Artificial Sequence: Synthetic oligonucleotide
  Target: ATXN1; (+) strand; PAM type: YTN; PAM sequence: CTA
attaagaccaataagaaagc

SEQ ID NO: 299954 - DNA, 20 bp, Artificial Sequence
  Description of Artificial Sequence: Synthetic oligonucleotide
  Target: ATXN1; (+) strand; PAM type: YTN; PAM sequence: TTA
agaccaataagaaagccatc

SEQ ID NO: 299955 - DNA, 20 bp, Artificial Sequence
  Description of Artificial Sequence: Synthetic oligonucleotide
  Target: ATXN1; (+) strand; PAM type: YTN; PAM sequence: TTC
cacgagacagccaggcttcc

SEQ ID NO: 299956 - DNA, 20 bp, Artificial Sequence
  Description of Artificial Sequence: Synthetic oligonucleotide
  Target: ATXN1; (+) strand; PAM type: YTN; PAM sequence: CTT
cccgttgtgtaattattcac

SEQ ID NO: 299957 - DNA, 20 bp, Artificial Sequence
  Description of Artificial Sequence: Synthetic oligonucleotide
  Target: ATXN1; (+) strand; PAM type: YTN; PAM sequence: TTC
ccgttgtgtaattattcacc

SEQ ID NO: 299958 - DNA, 20 bp, Artificial Sequence
  Description of Artificial Sequence: Synthetic oligonucleotide
  Target: ATXN1; (+) strand; PAM type: YTN; PAM sequence: TTG
tgtaattattcacctcatag

SEQ ID NO: 299959 - DNA, 20 bp, Artificial Sequence
  Description of Artificial Sequence: Synthetic oligonucleotide
  Target: ATXN1; (+) strand; PAM type: YTN; PAM sequence: TTA
ttcacctcatagtggtccac

SEQ ID NO: 299960 - DNA, 20 bp, Artificial Sequence
  Description of Artificial Sequence: Synthetic oligonucleotide
  Target: ATXN1; (+) strand; PAM type: YTN; PAM sequence: TTC
acctcatagtggtccacctt

SEQ ID NO: 299961 - DNA, 20 bp, Artificial Sequence
  Description of Artificial Sequence: Synthetic oligonucleotide
  Target: ATXN1; (+) strand; PAM type: YTN; PAM sequence: CTC
atagtggtccaccttgaagg

SEQ ID NO: 299962 - DNA, 20 bp, Artificial Sequence
  Description of Artificial Sequence: Synthetic oligonucleotide
  Target: ATXN1; (+) strand; PAM type: YTN; PAM sequence: CTT
gaaggcatgcaacacattat

SEQ ID NO: 299963 - DNA, 20 bp, Artificial Sequence
  Description of Artificial Sequence: Synthetic oligonucleotide
  Target: ATXN1; (+) strand; PAM type: YTN; PAM sequence: TTG
aaggcatgcaacacattatg

SEQ ID NO: 299964 - DNA, 20 bp, Artificial Sequence
  Description of Artificial Sequence: Synthetic oligonucleotide
  Target: ATXN1; (+) strand; PAM type: YTN; PAM sequence: TTA
tgccgaaaagagatatttat

SEQ ID NO: 299965 - DNA, 20 bp, Artificial Sequence
  Description of Artificial Sequence: Synthetic oligonucleotide
  Target: ATXN1; (+) strand; PAM type: YTN; PAM sequence: TTT
atatagaagggaattactta

SEQ ID NO: 299966 - DNA, 20 bp, Artificial Sequence
  Description of Artificial Sequence: Synthetic oligonucleotide
  Target: ATXN1; (+) strand; PAM type: YTN; PAM sequence: TTA
tatagaagggaattacttag

SEQ ID NO: 299967 - DNA, 20 bp, Artificial Sequence
  Description of Artificial Sequence: Synthetic oligonucleotide
  Target: ATXN1; (+) strand; PAM type: YTN; PAM sequence: TTA
cttaggacatgcggatgtcc

SEQ ID NO: 299968 - DNA, 20 bp, Artificial Sequence
  Description of Artificial Sequence: Synthetic oligonucleotide
  Target: ATXN1; (+) strand; PAM type: YTN; PAM sequence: CTT
aggacatgcggatgtcccta

SEQ ID NO: 299969 - DNA, 20 bp, Artificial Sequence
  Description of Artificial Sequence: Synthetic oligonucleotide
  Target: ATXN1; (+) strand; PAM type: YTN; PAM sequence: TTA
ggacatgcggatgtccctaa

SEQ ID NO: 299970 - DNA, 20 bp, Artificial Sequence
  Description of Artificial Sequence: Synthetic oligonucleotide
  Target: ATXN1; (+) strand; PAM type: YTN; PAM sequence: CTA
aaataaagattcttgaccac

SEQ ID NO: 299971 - DNA, 20 bp, Artificial Sequence
  Description of Artificial Sequence: Synthetic oligonucleotide
  Target: ATXN1; (+) strand; PAM type: YTN; PAM sequence: TTC
ttgaccactcgagctactca

SEQ ID NO: 299972 - DNA, 20 bp, Artificial Sequence
  Description of Artificial Sequence: Synthetic oligonucleotide
  Target: ATXN1; (+) strand; PAM type: YTN; PAM sequence: CTT
gaccactcgagctactcagt

SEQ ID NO: 299973 - DNA, 20 bp, Artificial Sequence
  Description of Artificial Sequence: Synthetic oligonucleotide
  Target: ATXN1; (+) strand; PAM type: YTN; PAM sequence: TTG
accactcgagctactcagta

SEQ ID NO: 299974 - DNA, 20 bp, Artificial Sequence
  Description of Artificial Sequence: Synthetic oligonucleotide
  Target: ATXN1; (+) strand; PAM type: YTN; PAM sequence: CTC
gagctactcagtatttctct

SEQ ID NO: 299975 - DNA, 20 bp, Artificial Sequence
  Description of Artificial Sequence: Synthetic oligonucleotide
  Target: ATXN1; (+) strand; PAM type: YTN; PAM sequence: CTA
ctcagtatttctctctaggc

SEQ ID NO: 299976 - DNA, 20 bp, Artificial Sequence
  Description of Artificial Sequence: Synthetic oligonucleotide
  Target: ATXN1; (+) strand; PAM type: YTN; PAM sequence: CTC
agtatttctctctaggctag

SEQ ID NO: 299977 - DNA, 20 bp, Artificial Sequence
  Description of Artificial Sequence: Synthetic oligonucleotide
  Target: ATXN1; (+) strand; PAM type: YTN; PAM sequence: TTT
ctctctaggctagaaacaga

SEQ ID NO: 299978 - DNA, 20 bp, Artificial Sequence
  Description of Artificial Sequence: Synthetic oligonucleotide
  Target: ATXN1; (+) strand; PAM type: YTN; PAM sequence: TTC
tctctaggctagaaacagaa

SEQ ID NO: 299979 - DNA, 20 bp, Artificial Sequence
  Description of Artificial Sequence: Synthetic oligonucleotide
  Target: ATXN1; (+) strand; PAM type: YTN; PAM sequence: CTC
tctaggctagaaacagaaaa

SEQ ID NO: 299980 - DNA, 20 bp, Artificial Sequence
  Description of Artificial Sequence: Synthetic oligonucleotide
  Target: ATXN1; (+) strand; PAM type: YTN; PAM sequence: CTC
taggctagaaacagaaaaga

SEQ ID NO: 299981 - DNA, 20 bp, Artificial Sequence
  Description of Artificial Sequence: Synthetic oligonucleotide
  Target: ATXN1; (+) strand; PAM type: YTN; PAM sequence: CTA
ggctagaaacagaaaagatt

SEQ ID NO: 299982 - DNA, 20 bp, Artificial Sequence
  Description of Artificial Sequence: Synthetic oligonucleotide
  Target: ATXN1; (+) strand; PAM type: YTN; PAM sequence: CTA
gaaacagaaaagattaaata

SEQ ID NO: 299983 - DNA, 20 bp, Artificial Sequence
  Description of Artificial Sequence: Synthetic oligonucleotide
  Target: ATXN1; (+) strand; PAM type: YTN; PAM sequence: TTA
aataacatattcatatggga

SEQ ID NO: 299984 - DNA, 20 bp, Artificial Sequence
  Description of Artificial Sequence: Synthetic oligonucleotide
  Target: ATXN1; (+) strand; PAM type: YTN; PAM sequence: TTC
atatgggaagtcaatttttc

SEQ ID NO: 299985 - DNA, 20 bp, Artificial Sequence
  Description of Artificial Sequence: Synthetic oligonucleotide
  Target: ATXN1; (+) strand; PAM type: YTN; PAM sequence: TTT
ttccatcaatgaaaagcaag

SEQ ID NO: 299986 - DNA, 20 bp, Artificial Sequence
  Description of Artificial Sequence: Synthetic oligonucleotide
  Target: ATXN1; (+) strand; PAM type: YTN; PAM sequence: TTT
tccatcaatgaaaagcaaga

SEQ ID NO: 299987 - DNA, 20 bp, Artificial Sequence
  Description of Artificial Sequence: Synthetic oligonucleotide
  Target: ATXN1; (+) strand; PAM type: YTN; PAM sequence: TTT
ccatcaatgaaaagcaagaa

SEQ ID NO: 299988 - DNA, 20 bp, Artificial Sequence
  Description of Artificial Sequence: Synthetic oligonucleotide
  Target: ATXN1; (+) strand; PAM type: YTN; PAM sequence: TTC
catcaatgaaaagcaagaaa

SEQ ID NO: 299989 - DNA, 20 bp, Artificial Sequence
  Description of Artificial Sequence: Synthetic oligonucleotide
  Target: ATXN1; (+) strand; PAM type: YTN; PAM sequence: TTT
caaggcaagatcttttaaag

SEQ ID NO: 299990 - DNA, 20 bp, Artificial Sequence
  Description of Artificial Sequence: Synthetic oligonucleotide
  Target: ATXN1; (+) strand; PAM type: YTN; PAM sequence: TTC
aaggcaagatcttttaaagt

SEQ ID NO: 299991 - DNA, 20 bp, Artificial Sequence
  Description of Artificial Sequence: Synthetic oligonucleotide
  Target: ATXN1; (+) strand; PAM type: YTN; PAM sequence: CTT
ttaaagtcctacaaatattt

SEQ ID NO: 299992 - DNA, 20 bp, Artificial Sequence
  Description of Artificial Sequence: Synthetic oligonucleotide
  Target: ATXN1; (+) strand; PAM type: YTN; PAM sequence: TTT
taaagtcctacaaatattta

SEQ ID NO: 299993 - DNA, 20 bp, Artificial Sequence
  Description of Artificial Sequence: Synthetic oligonucleotide
  Target: ATXN1; (+) strand; PAM type: YTN; PAM sequence: TTT
aaagtcctacaaatatttaa

SEQ ID NO: 299994 - DNA, 20 bp, Artificial Sequence
  Description of Artificial Sequence: Synthetic oligonucleotide
  Target: ATXN1; (+) strand; PAM type: YTN; PAM sequence: TTA
aagtcctacaaatatttaag

SEQ ID NO: 299995 - DNA, 20 bp, Artificial Sequence
  Description of Artificial Sequence: Synthetic oligonucleotide
  Target: ATXN1; (+) strand; PAM type: YTN; PAM sequence: CTA
caaatatttaagtataacct

SEQ ID NO: 299996 - DNA, 20 bp, Artificial Sequence
  Description of Artificial Sequence: Synthetic oligonucleotide
  Target: ATXN1; (+) strand; PAM type: YTN; PAM sequence: TTT
aagtataacctctctacact

SEQ ID NO: 299997 - DNA, 20 bp, Artificial Sequence
  Description of Artificial Sequence: Synthetic oligonucleotide
  Target: ATXN1; (+) strand; PAM type: YTN; PAM sequence: TTA
agtataacctctctacactt

SEQ ID NO: 299998 - DNA, 20 bp, Artificial Sequence
  Description of Artificial Sequence: Synthetic oligonucleotide
  Target: ATXN1; (+) strand; PAM type: YTN; PAM sequence: CTC
tctacactttttaaaaatac

SEQ ID NO: 299999 - DNA, 20 bp, Artificial Sequence
  Description of Artificial Sequence: Synthetic oligonucleotide
  Target: ATXN1; (+) strand; PAM type: YTN; PAM sequence: CTC
tacactttttaaaaatacag

SEQ ID NO: 300000 - DNA, 20 bp, Artificial Sequence
  Description of Artificial Sequence: Synthetic oligonucleotide
  Target: ATXN1; (+) strand; PAM type: YTN; PAM sequence: CTA
cactttttaaaaatacagtt

SEQ ID NO: 300001 - DNA, 20 bp, Artificial Sequence
  Description of Artificial Sequence: Synthetic oligonucleotide
  Target: ATXN1; (+) strand; PAM type: YTN; PAM sequence: CTT
tttaaaaatacagtttattt

SEQ ID NO: 300002 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatacagtttattta

SEQ ID NO: 300003 - DNA, 20 bp, Artificial Sequence
  Description of Artificial Sequence: Synthetic oligonucleotide
  Target: ATXN1; (+) strand; PAM type: YTN; PAM sequence: TTT
taaaaatacagtttatttaa

SEQ ID NO: 300004 - DNA, 20 bp, Artificial Sequence
  Description of Artificial Sequence: Synthetic oligonucleotide
  Target: ATXN1; (+) strand; PAM type: YTN; PAM sequence: TTT
aaaaatacagtttatttaaa

SEQ ID NO: 300005 - DNA, 20 bp, Artificial Sequence
  Description of Artificial Sequence: Synthetic oligonucleotide
  Target: ATXN1; (+) strand; PAM type: YTN; PAM sequence: TTA
aaaatacagtttatttaaag

SEQ ID NO: 300006 - DNA, 20 bp, Artificial Sequence
  Description of Artificial Sequence: Synthetic oligonucleotide
  Target: ATXN1; (+) strand; PAM type: YTN; PAM sequence: TTT
atttaaagatataaggaaag

SEQ ID NO: 300007 - DNA, 20 bp, Artificial Sequence
  Description of Artificial Sequence: Synthetic oligonucleotide
  Target: ATXN1; (+) strand; PAM type: YTN; PAM sequence: TTA
tttaaagatataaggaaagt

SEQ ID NO: 300008 - DNA, 20 bp, Artificial Sequence
  Description of Artificial Sequence: Synthetic oligonucleotide
  Target: ATXN1; (+) strand; PAM type: YTN; PAM sequence: TTT
aaagatataaggaaagtcca

SEQ ID NO: 300009 - DNA, 20 bp, Artificial Sequence
  Description of Artificial Sequence: Synthetic oligonucleotide
  Target: ATXN1; (+) strand; PAM type: YTN; PAM sequence: TTA
aagatataaggaaagtccat

SEQ ID NO: 300010 - DNA, 20 bp, Artificial Sequence
  Description of Artificial Sequence: Synthetic oligonucleotide
  Target: ATXN1; (+) strand; PAM type: YTN; PAM sequence: TTT
actgagaacctcctttgtgg

SEQ ID NO: 300011 - DNA, 20 bp, Artificial Sequence
  Description of Artificial Sequence: Synthetic oligonucleotide
  Target: ATXN1; (+) strand; PAM type: YTN; PAM sequence: TTA
ctgagaacctcctttgtggc

SEQ ID NO: 300012 - DNA, 20 bp, Artificial Sequence
  Description of Artificial Sequence: Synthetic oligonucleotide
  Target: ATXN1; (+) strand; PAM type: YTN; PAM sequence: CTG
agaacctcctttgtggccag

SEQ ID NO: 300013 - DNA, 20 bp, Artificial Sequence
  Description of Artificial Sequence: Synthetic oligonucleotide
  Target: ATXN1; (+) strand; PAM type: YTN; PAM sequence: CTC
ctttgtggccaggattatgt

SEQ ID NO: 300014 - DNA, 20 bp, Artificial Sequence
  Description of Artificial Sequence: Synthetic oligonucleotide
  Target: ATXN1; (+) strand; PAM type: YTN; PAM sequence: CTT
tgtggccaggattatgtttc

SEQ ID NO: 300015 - DNA, 20 bp, Artificial Sequence
  Description of Artificial Sequence: Synthetic oligonucleotide
  Target: ATXN1; (+) strand; PAM type: YTN; PAM sequence: TTT
gtggccaggattatgtttct

SEQ ID NO: 300016 - DNA, 20 bp, Artificial Sequence
  Description of Artificial Sequence: Synthetic oligonucleotide
  Target: ATXN1; (+) strand; PAM type: YTN; PAM sequence: TTG
tggccaggattatgtttcta

SEQ ID NO: 300017 - DNA, 20 bp, Artificial Sequence
  Description of Artificial Sequence: Synthetic oligonucleotide
  Target: ATXN1; (+) strand; PAM type: YTN; PAM sequence: TTA
tgtttctatctaagtcccat

SEQ ID NO: 300018 - DNA, 20 bp, Artificial Sequence
  Description of Artificial Sequence: Synthetic oligonucleotide
  Target: ATXN1; (+) strand; PAM type: YTN; PAM sequence: TTT
ctatctaagtcccatgaact

SEQ ID NO: 300019 - DNA, 20 bp, Artificial Sequence
  Description of Artificial Sequence: Synthetic oligonucleotide
  Target: ATXN1; (+) strand; PAM type: YTN; PAM sequence: TTC
tatctaagtcccatgaactt

SEQ ID NO: 300020 - DNA, 20 bp, Artificial Sequence
  Description of Artificial Sequence: Synthetic oligonucleotide
  Target: ATXN1; (+) strand; PAM type: YTN; PAM sequence: CTA
tctaagtcccatgaacttgg

SEQ ID NO: 300021 - DNA, 20 bp, Artificial Sequence
  Description of Artificial Sequence: Synthetic oligonucleotide
  Target: ATXN1; (+) strand; PAM type: YTN; PAM sequence: CTA
agtcccatgaacttggagca

SEQ ID NO: 300022 - DNA, 20 bp, Artificial Sequence
  Description of Artificial Sequence: Synthetic oligonucleotide
  Target: ATXN1; (+) strand; PAM type: YTN; PAM sequence: CTT
ggagcatatttacaaaatta

SEQ ID NO: 300023 - DNA, 20 bp, Artificial Sequence
  Description of Artificial Sequence: Synthetic oligonucleotide
  Target: ATXN1; (+) strand; PAM type: YTN; PAM sequence: TTG
gagcatatttacaaaattat

SEQ ID NO: 300024 - DNA, 20 bp, Artificial Sequence
  Description of Artificial Sequence: Synthetic oligonucleotide
  Target: ATXN1; (+) strand; PAM type: YTN; PAM sequence: TTT
acaaaattatttaactttat

SEQ ID NO: 300025 - DNA, 20 bp, Artificial Sequence
  Description of Artificial Sequence: Synthetic oligonucleotide
  Target: ATXN1; (+) strand; PAM type: YTN; PAM sequence: TTA
caaaattatttaactttata

SEQ ID NO: 300026 - DNA, 20 bp, Artificial Sequence
  Description of Artificial Sequence: Synthetic oligonucleotide
  Target: ATXN1; (+) strand; PAM type: YTN; PAM sequence: TTA
tttaactttataaagtattt

SEQ ID NO: 300027 - DNA, 20 bp, Artificial Sequence
  Description of Artificial Sequence: Synthetic oligonucleotide
  Target: ATXN1; (+) strand; PAM type: YTN; PAM sequence: TTT
aactttataaagtatttcaa

SEQ ID NO: 300028 - DNA, 20 bp, Artificial Sequence
  Description of Artificial Sequence: Synthetic oligonucleotide
  Target: ATXN1; (+) strand; PAM type: YTN; PAM sequence: TTA
actttataaagtatttcaat

SEQ ID NO: 300029 - DNA, 20 bp, Artificial Sequence
  Description of Artificial Sequence: Synthetic oligonucleotide
  Target: ATXN1; (+) strand; PAM type: YTN; PAM sequence: CTT
tataaagtatttcaatgaat

SEQ ID NO: 300030 - DNA, 20 bp, Artificial Sequence
  Description of Artificial Sequence: Synthetic oligonucleotide
  Target: ATXN1; (+) strand; PAM type: YTN; PAM sequence: TTT
ataaagtatttcaatgaata

SEQ ID NO: 300031 - DNA, 20 bp, Artificial Sequence
  Description of Artificial Sequence: Synthetic oligonucleotide
  Target: ATXN1; (+) strand; PAM type: YTN; PAM sequence: TTA
taaagtatttcaatgaataa

SEQ ID NO: 300032 - DNA, 20 bp, Artificial Sequence
  Description of Artificial Sequence: Synthetic oligonucleotide
  Target: ATXN1; (+) strand; PAM type: YTN; PAM sequence: TTT
caatgaataatgcagtcttc

SEQ ID NO: 300033 - DNA, 20 bp, Artificial Sequence
  Description of Artificial Sequence: Synthetic oligonucleotide
  Target: ATXN1; (+) strand; PAM type: YTN; PAM sequence: TTC
aatgaataatgcagtcttcc

SEQ ID NO: 300034 - DNA, 20 bp, Artificial Sequence
  Description of Artificial Sequence: Synthetic oligonucleotide
  Target: ATXN1; (+) strand; PAM type: YTN; PAM sequence: CTT
ccaaaatgtgcatggggctg

SEQ ID NO: 300035 - DNA, 20 bp, Artificial Sequence
  Description of Artificial Sequence: Synthetic oligonucleotide
  Target: ATXN1; (+) strand; PAM type: YTN; PAM sequence: TTC
caaaatgtgcatggggctgt

SEQ ID NO: 300036 - DNA, 20 bp, Artificial Sequence
  Description of Artificial Sequence: Synthetic oligonucleotide
  Target: ATXN1; (+) strand; PAM type: YTN; PAM sequence: CTG
taattccatctagtgtttac

SEQ ID NO: 300037 - DNA, 20 bp, Artificial Sequence
  Description of Artificial Sequence: Synthetic oligonucleotide
  Target: ATXN1; (+) strand; PAM type: YTN; PAM sequence: TTC
catctagtgtttacaatgac

SEQ ID NO: 300038 - DNA, 20 bp, Artificial Sequence
  Description of Artificial Sequence: Synthetic oligonucleotide
  Target: ATXN1; (+) strand; PAM type: YTN; PAM sequence: CTA
gtgtttacaatgacactata

SEQ ID NO: 300039 - DNA, 20 bp, Artificial Sequence
  Description of Artificial Sequence: Synthetic oligonucleotide
  Target: ATXN1; (+) strand; PAM type: YTN; PAM sequence: TTT
acaatgacactataagcctt

SEQ ID NO: 300040 - DNA, 20 bp, Artificial Sequence
  Description of Artificial Sequence: Synthetic oligonucleotide
  Target: ATXN1; (+) strand; PAM type: YTN; PAM sequence: TTA
caatgacactataagccttg

SEQ ID NO: 300041 - DNA, 20 bp, Artificial Sequence
  Description of Artificial Sequence: Synthetic oligonucleotide
  Target: ATXN1; (+) strand; PAM type: YTN; PAM sequence: CTA
taagccttggatggaattac

SEQ ID NO: 300042 - DNA, 20 bp, Artificial Sequence
  Description of Artificial Sequence: Synthetic oligonucleotide
  Target: ATXN1; (+) strand; PAM type: YTN; PAM sequence: CTT
ggatggaattacaatcttaa

SEQ ID NO: 300043 - DNA, 20 bp, Artificial Sequence
  Description of Artificial Sequence: Synthetic oligonucleotide
  Target: ATXN1; (+) strand; PAM type: YTN; PAM sequence: TTG
gatggaattacaatcttaat

SEQ ID NO: 300044 - DNA, 20 bp, Artificial Sequence
  Description of Artificial Sequence: Synthetic oligonucleotide
  Target: ATXN1; (+) strand; PAM type: YTN; PAM sequence: TTA
caatcttaatgggaacaatc

SEQ ID NO: 300045 - DNA, 20 bp, Artificial Sequence
  Description of Artificial Sequence: Synthetic oligonucleotide
  Target: ATXN1; (+) strand; PAM type: YTN; PAM sequence: CTT
aatgggaacaatcagagtgc

SEQ ID NO: 300046 - DNA, 20 bp, Artificial Sequence
  Description of Artificial Sequence: Synthetic oligonucleotide
  Target: ATXN1; (+) strand; PAM type: YTN; PAM sequence: TTA
atgggaacaatcagagtgca

SEQ ID NO: 300047 - DNA, 20 bp, Artificial Sequence
  Description of Artificial Sequence: Synthetic oligonucleotide
  Target: ATXN1; (+) strand; PAM type: YTN; PAM sequence: CTA
ctccatatgctcagagaatt

SEQ ID NO: 300048 - DNA, 20 bp, Artificial Sequence
  Description of Artificial Sequence: Synthetic oligonucleotide
  Target: ATXN1; (+) strand; PAM type: YTN; PAM sequence: CTC
catatgctcagagaattcag

SEQ ID NO: 300049 - DNA, 20 bp, Artificial Sequence
  Description of Artificial Sequence: Synthetic oligonucleotide
  Target: ATXN1; (+) strand; PAM type: YTN; PAM sequence: CTC
agagaattcaggatgaactc

SEQ ID NO: 300050 - DNA, 20 bp, Artificial Sequence
  Description of Artificial Sequence: Synthetic oligonucleotide
  Target: ATXN1; (+) strand; PAM type: YTN; PAM sequence: TTC
aggatgaactcaacttctaa

SEQ ID NO: 300051 - DNA, 20 bp, Artificial Sequence
  Description of Artificial Sequence: Synthetic oligonucleotide
  Target: ATXN1; (+) strand; PAM type: YTN; PAM sequence: CTC
aacttctaaaataaaaagca

SEQ ID NO: 300052 - DNA, 20 bp, Artificial Sequence
  Description of Artificial Sequence: Synthetic oligonucleotide
  Target: ATXN1; (+) strand; PAM type: YTN; PAM sequence: CTT
ctaaaataaaaagcaccaag

SEQ ID NO: 300053 - DNA, 20 bp, Artificial Sequence
  Description of Artificial Sequence: Synthetic oligonucleotide
  Target: ATXN1; (+) strand; PAM type: YTN; PAM sequence: TTC
taaaataaaaagcaccaagc

SEQ ID NO: 300054 - DNA, 20 bp, Artificial Sequence
  Description of Artificial Sequence: Synthetic oligonucleotide
  Target: ATXN1; (+) strand; PAM type: YTN; PAM sequence: CTA
aaataaaaagcaccaagcca

SEQ ID NO: 300055 - DNA, 20 bp, Artificial Sequence
  Description of Artificial Sequence: Synthetic oligonucleotide
  Target: ATXN1; (+) strand; PAM type: YTN; PAM sequence: TTG
gcatgtaattacaaccagga

SEQ ID NO: 300056 - DNA, 20 bp, Artificial Sequence
  Description of Artificial Sequence: Synthetic oligonucleotide
  Target: ATXN1; (+) strand; PAM type: YTN; PAM sequence: TTA
caaccaggaggccaagctgt

SEQ ID NO: 300057 - DNA, 20 bp, Artificial Sequence
  Description of Artificial Sequence: Synthetic oligonucleotide
  Target: ATXN1; (+) strand; PAM type: YTN; PAM sequence: CTG
tctgcttgctagtatatgag

SEQ ID NO: 300058 - DNA, 20 bp, Artificial Sequence
  Description of Artificial Sequence: Synthetic oligonucleotide
  Target: ATXN1; (+) strand; PAM type: YTN; PAM sequence: CTG
cttgctagtatatgagaaat

SEQ ID NO: 300059 - DNA, 20 bp, Artificial Sequence
  Description of Artificial Sequence: Synthetic oligonucleotide
  Target: ATXN1; (+) strand; PAM type: YTN; PAM sequence: CTT
gctagtatatgagaaatgct

SEQ ID NO: 300060 - DNA, 20 bp, Artificial Sequence
  Description of Artificial Sequence: Synthetic oligonucleotide
  Target: ATXN1; (+) strand; PAM type: YTN; PAM sequence: TTG
ctagtatatgagaaatgctc

SEQ ID NO: 300061 - DNA, 20 bp, Artificial Sequence
  Description of Artificial Sequence: Synthetic oligonucleotide
  Target: ATXN1; (+) strand; PAM type: YTN; PAM sequence: CTA
gtatatgagaaatgctcaat

SEQ ID NO: 300062 - DNA, 20 bp, Artificial Sequence
  Description of Artificial Sequence: Synthetic oligonucleotide
  Target: ATXN1; (+) strand; PAM type: YTN; PAM sequence: CTC
aattgaaagtaccatctcac

SEQ ID NO: 300063 - DNA, 20 bp, Artificial Sequence
  Description of Artificial Sequence: Synthetic oligonucleotide
  Target: ATXN1; (+) strand; PAM type: YTN; PAM sequence: TTG
aaagtaccatctcaccttat

SEQ ID NO: 300064 - DNA, 20 bp, Artificial Sequence
  Description of Artificial Sequence: Synthetic oligonucleotide
  Target: ATXN1; (+) strand; PAM type: YTN; PAM sequence: CTC
accttattgtagcaaaacct

SEQ ID NO: 300065 - DNA, 20 bp, Artificial Sequence
  Description of Artificial Sequence: Synthetic oligonucleotide
  Target: ATXN1; (+) strand; PAM type: YTN; PAM sequence: CTT
attgtagcaaaacctattta

SEQ ID NO: 300066 - DNA, 20 bp, Artificial Sequence
  Description of Artificial Sequence: Synthetic oligonucleotide
  Target: ATXN1; (+) strand; PAM type: YTN; PAM sequence: TTA
ttgtagcaaaacctatttaa

SEQ ID NO: 300067 - DNA, 20 bp, Artificial Sequence
  Description of Artificial Sequence: Synthetic oligonucleotide
  Target: ATXN1; (+) strand; PAM type: YTN; PAM sequence: TTG
tagcaaaacctatttaatgt

SEQ ID NO: 300068 - DNA, 20 bp, Artificial Sequence
  Description of Artificial Sequence: Synthetic oligonucleotide
  Target: ATXN1; (+) strand; PAM type: YTN; PAM sequence: CTA
tttaatgtatctgaaaaacc

SEQ ID NO: 300069 - DNA, 20 bp, Artificial Sequence
  Description of Artificial Sequence: Synthetic oligonucleotide
  Target: ATXN1; (+) strand; PAM type: YTN; PAM sequence: TTT
aatgtatctgaaaaacctct

SEQ ID NO: 300070 - DNA, 20 bp, Artificial Sequence
  Description of Artificial Sequence: Synthetic oligonucleotide
  Target: ATXN1; (+) strand; PAM type: YTN; PAM sequence: TTA
atgtatctgaaaaacctctt

SEQ ID NO: 300071 - DNA, 20 bp, Artificial Sequence
  Description of Artificial Sequence: Synthetic oligonucleotide
  Target: ATXN1; (+) strand; PAM type: YTN; PAM sequence: CTG
aaaaacctcttcctctccaa

SEQ ID NO: 300072 - DNA, 20 bp, Artificial Sequence
  Description of Artificial Sequence: Synthetic oligonucleotide
  Target: ATXN1; (+) strand; PAM type: YTN; PAM sequence: CTC
ttcctctccaaaattaaact

SEQ ID NO: 300073 - DNA, 20 bp, Artificial Sequence
  Description of Artificial Sequence: Synthetic oligonucleotide
  Target: ATXN1; (+) strand; PAM type: YTN; PAM sequence: CTT
cctctccaaaattaaacttt

SEQ ID NO: 300074 - DNA, 20 bp, Artificial Sequence
  Description of Artificial Sequence: Synthetic oligonucleotide
  Target: ATXN1; (+) strand; PAM type: YTN; PAM sequence: TTC
ctctccaaaattaaactttc

SEQ ID NO: 300075 - DNA, 20 bp, Artificial Sequence
  Description of Artificial Sequence: Synthetic oligonucleotide
  Target: ATXN1; (+) strand; PAM type: YTN; PAM sequence: CTC
tccaaaattaaactttcgac

SEQ ID NO: 300076 - DNA, 20 bp, Artificial Sequence
  Description of Artificial Sequence: Synthetic oligonucleotide
  Target: ATXN1; (+) strand; PAM type: YTN; PAM sequence: CTC
caaaattaaactttcgactt

SEQ ID NO: 300077 - DNA, 20 bp, Artificial Sequence
  Description of Artificial Sequence: Synthetic oligonucleotide
  Target: ATXN1; (+) strand; PAM type: YTN; PAM sequence: TTA
aactttcgactttcgtgatg

SEQ ID NO: 300078 - DNA, 20 bp, Artificial Sequence
  Description of Artificial Sequence: Synthetic oligonucleotide
  Target: ATXN1; (+) strand; PAM type: YTN; PAM sequence: CTT
tcgactttcgtgatgagaaa

SEQ ID NO: 300079 - DNA, 20 bp, Artificial Sequence
  Description of Artificial Sequence: Synthetic oligonucleotide
  Target: ATXN1; (+) strand; PAM type: YTN; PAM sequence: TTT
cgactttcgtgatgagaaaa

SEQ ID NO: 300080 - DNA, 20 bp, Artificial Sequence
  Description of Artificial Sequence: Synthetic oligonucleotide
  Target: ATXN1; (+) strand; PAM type: YTN; PAM sequence: TTC
gactttcgtgatgagaaaat

SEQ ID NO: 300081 - DNA, 20 bp, Artificial Sequence
  Description of Artificial Sequence: Synthetic oligonucleotide
  Target: ATXN1; (+) strand; PAM type: YTN; PAM sequence: CTT
tcgtgatgagaaaatttcca

SEQ ID NO: 300082 - DNA, 20 bp, Artificial Sequence
  Description of Artificial Sequence: Synthetic oligonucleotide
  Target: ATXN1; (+) strand; PAM type: YTN; PAM sequence: TTT
cgtgatgagaaaatttccac

SEQ ID NO: 300083 - DNA, 20 bp, Artificial Sequence
  Description of Artificial Sequence: Synthetic oligonucleotide
  Target: ATXN1; (+) strand; PAM type: YTN; PAM sequence: TTC
gtgatgagaaaatttccaca

SEQ ID NO: 300084 - DNA, 20 bp, Artificial Sequence
  Description of Artificial Sequence: Synthetic oligonucleotide
  Target: ATXN1; (+) strand; PAM type: YTN; PAM sequence: TTT
ccacaagggtctaccacata

SEQ ID NO: 300085 - DNA, 20 bp, Artificial Sequence
  Description of Artificial Sequence: Synthetic oligonucleotide
  Target: ATXN1; (+) strand; PAM type: YTN; PAM sequence: TTC
cacaagggtctaccacatag

SEQ ID NO: 300086 - DNA, 20 bp, Artificial Sequence
  Description of Artificial Sequence: Synthetic oligonucleotide
  Target: ATXN1; (+) strand; PAM type: YTN; PAM sequence: CTA
ccacatagaggtgatatata

SEQ ID NO: 300087 - DNA, 20 bp, Artificial Sequence
  Description of Artificial Sequence: Synthetic oligonucleotide
  Target: ATXN1; (+) strand; PAM type: YTN; PAM sequence: TTG
tctggatgctaccaataaaa

SEQ ID NO: 300088 - DNA, 20 bp, Artificial Sequence
  Description of Artificial Sequence: Synthetic oligonucleotide
  Target: ATXN1; (+) strand; PAM type: YTN; PAM sequence: CTG
gatgctaccaataaaatcta

SEQ ID NO: 300089 - DNA, 20 bp, Artificial Sequence
  Description of Artificial Sequence: Synthetic oligonucleotide
  Target: ATXN1; (+) strand; PAM type: YTN; PAM sequence: CTA
ccaataaaatctaagaatct

SEQ ID NO: 300090 - DNA, 20 bp, Artificial Sequence
  Description of Artificial Sequence: Synthetic oligonucleotide
  Target: ATXN1; (+) strand; PAM type: YTN; PAM sequence: CTA
agaatcttctaataccacct

SEQ ID NO: 300091 - DNA, 20 bp, Artificial Sequence
  Description of Artificial Sequence: Synthetic oligonucleotide
  Target: ATXN1; (+) strand; PAM type: YTN; PAM sequence: CTT
ctaataccacctacatgcac

SEQ ID NO: 300092 - DNA, 20 bp, Artificial Sequence
  Description of Artificial Sequence: Synthetic oligonucleotide
  Target: ATXN1; (+) strand; PAM type: YTN; PAM sequence: TTC
taataccacctacatgcacc

SEQ ID NO: 300093 - DNA, 20 bp, Artificial Sequence
  Description of Artificial Sequence: Synthetic oligonucleotide
  Target: ATXN1; (+) strand; PAM type: YTN; PAM sequence: CTA
ataccacctacatgcaccta

SEQ ID NO: 300094 - DNA, 20 bp, Artificial Sequence
  Description of Artificial Sequence: Synthetic oligonucleotide
  Target: ATXN1; (+) strand; PAM type: YTN; PAM sequence: CTA
catgcacctaaacttaaact

SEQ ID NO: 300095 - DNA, 20 bp, Artificial Sequence
  Description of Artificial Sequence: Synthetic oligonucleotide
  Target: ATXN1; (+) strand; PAM type: YTN; PAM sequence: CTA
aacttaaactctgaaaagta

SEQ ID NO: 300096 - DNA, 20 bp, Artificial Sequence
  Description of Artificial Sequence: Synthetic oligonucleotide
  Target: ATXN1; (+) strand; PAM type: YTN; PAM sequence: CTT
aaactctgaaaagtacaatg

SEQ ID NO: 300097 - DNA, 20 bp, Artificial Sequence
  Description of Artificial Sequence: Synthetic oligonucleotide
  Target: ATXN1; (+) strand; PAM type: YTN; PAM sequence: TTA
aactctgaaaagtacaatgt

SEQ ID NO: 300098 - DNA, 20 bp, Artificial Sequence
  Description of Artificial Sequence: Synthetic oligonucleotide
  Target: ATXN1; (+) strand; PAM type: YTN; PAM sequence: CTC
tgaaaagtacaatgtattaa

SEQ ID NO: 300099 - DNA, 20 bp, Artificial Sequence
  Description of Artificial Sequence: Synthetic oligonucleotide
  Target: ATXN1; (+) strand; PAM type: YTN; PAM sequence: CTG
aaaagtacaatgtattaaga

SEQ ID NO: 300100 - DNA, 20 bp, Artificial Sequence
  Description of Artificial Sequence: Synthetic oligonucleotide
  Target: ATXN1; (+) strand; PAM type: YTN; PAM sequence: TTA
agaaacaggaaaaaaaatca

SEQ ID NO: 300101 - DNA, 20 bp, Artificial Sequence
  Description of Artificial Sequence: Synthetic oligonucleotide
  Target: ATXN1; (+) strand; PAM type: YTN; PAM sequence: CTC
aagagccctttgaaattact

SEQ ID NO: 300102 - DNA, 20 bp, Artificial Sequence
  Description of Artificial Sequence: Synthetic oligonucleotide
  Target: ATXN1; (+) strand; PAM type: YTN; PAM sequence: CTT
tgaaattactggcatttctt

SEQ ID NO: 300103 - DNA, 20 bp, Artificial Sequence
  Description of Artificial Sequence: Synthetic oligonucleotide
  Target: ATXN1; (+) strand; PAM type: YTN; PAM sequence: TTT
gaaattactggcatttcttc

SEQ ID NO: 300104 - DNA, 20 bp, Artificial Sequence
  Description of Artificial Sequence: Synthetic oligonucleotide
  Target: ATXN1; (+) strand; PAM type: YTN; PAM sequence: TTG
aaattactggcatttcttct

SEQ ID NO: 300105 - DNA, 20 bp, Artificial Sequence
  Description of Artificial Sequence: Synthetic oligonucleotide
  Target: ATXN1; (+) strand; PAM type: YTN; PAM sequence: TTA
ctggcatttcttctaatttt

SEQ ID NO: 300106 - DNA, 20 bp, Artificial Sequence
  Description of Artificial Sequence: Synthetic oligonucleotide
  Target: ATXN1; (+) strand; PAM type: YTN; PAM sequence: CTG
gcatttcttctaatttttgg

SEQ ID NO: 300107 - DNA, 20 bp, Artificial Sequence
  Description of Artificial Sequence: Synthetic oligonucleotide
  Target: ATXN1; (+) strand; PAM type: YTN; PAM sequence: TTT
cttctaatttttgggggcta

SEQ ID NO: 300108 - DNA, 20 bp, Artificial Sequence
  Description of Artificial Sequence: Synthetic oligonucleotide
  Target: ATXN1; (+) strand; PAM type: YTN; PAM sequence: TTC
ttctaatttttgggggctag

SEQ ID NO: 300109 - DNA, 20 bp, Artificial Sequence
  Description of Artificial Sequence: Synthetic oligonucleotide
  Target: ATXN1; (+) strand; PAM type: YTN; PAM sequence: CTT
ctaatttttgggggctagtc

SEQ ID NO: 300110 - DNA, 20 bp, Artificial Sequence
  Description of Artificial Sequence: Synthetic oligonucleotide
  Target: ATXN1; (+) strand; PAM type: YTN; PAM sequence: TTC
taatttttgggggctagtct

SEQ ID NO: 300111 - DNA, 20 bp, Artificial Sequence
  Description of Artificial Sequence: Synthetic oligonucleotide
  Target: ATXN1; (+) strand; PAM type: YTN; PAM sequence: CTA
atttttgggggctagtctga

SEQ ID NO: 300112 - DNA, 20 bp, Artificial Sequence
  Description of Artificial Sequence: Synthetic oligonucleotide
  Target: ATXN1; (+) strand; PAM type: YTN; PAM sequence: TTT
ttgggggctagtctgacatt

SEQ ID NO: 300113 - DNA, 20 bp, Artificial Sequence
  Description of Artificial Sequence: Synthetic oligonucleotide
  Target: ATXN1; (+) strand; PAM type: YTN; PAM sequence: TTT
tgggggctagtctgacattt

SEQ ID NO: 300114 - DNA, 20 bp, Artificial Sequence
  Description of Artificial Sequence: Synthetic oligonucleotide
  Target: ATXN1; (+) strand; PAM type: YTN; PAM sequence: TTT
gggggctagtctgacattta

SEQ ID NO: 300115 - DNA, 20 bp, Artificial Sequence
  Description of Artificial Sequence: Synthetic oligonucleotide
  Target: ATXN1; (+) strand; PAM type: YTN; PAM sequence: TTG
ggggctagtctgacatttat

SEQ ID NO: 300116 - DNA, 20 bp, Artificial Sequence
  Description of Artificial Sequence: Synthetic oligonucleotide
  Target: ATXN1; (+) strand; PAM type: YTN; PAM sequence: CTA
gtctgacatttattagcata

SEQ ID NO: 300117 - DNA, 20 bp, Artificial Sequence
  Description of Artificial Sequence: Synthetic oligonucleotide
  Target: ATXN1; (+) strand; PAM type: YTN; PAM sequence: CTG
acatttattagcataaacaa

SEQ ID NO: 300118 - DNA, 20 bp, Artificial Sequence
  Description of Artificial Sequence: Synthetic oligonucleotide
  Target: ATXN1; (+) strand; PAM type: YTN; PAM sequence: TTT
attagcataaacaaagcaaa

SEQ ID NO: 300119 - DNA, 20 bp, Artificial Sequence
  Description of Artificial Sequence: Synthetic oligonucleotide
  Target: ATXN1; (+) strand; PAM type: YTN; PAM sequence: TTA
ttagcataaacaaagcaaag

SEQ ID NO: 300120 - DNA, 20 bp, Artificial Sequence
  Description of Artificial Sequence: Synthetic oligonucleotide
  Target: ATXN1; (+) strand; PAM type: YTN; PAM sequence: TTA
gcataaacaaagcaaagtgc

SEQ ID NO: 300121 - DNA, 20 bp, Artificial Sequence
  Description of Artificial Sequence: Synthetic oligonucleotide
  Target: ATXN1; (+) strand; PAM type: YTN; PAM sequence: CTT
gtgtccgcaagagggaaaaa

SEQ ID NO: 300122 - DNA, 20 bp, Artificial Sequence
  Description of Artificial Sequence: Synthetic oligonucleotide
  Target: ATXN1; (+) strand; PAM type: YTN; PAM sequence: TTG
tgtccgcaagagggaaaaaa

SEQ ID NO: 300123 - DNA, 20 bp, Artificial Sequence
  Description of Artificial Sequence: Synthetic oligonucleotide
  Target: ATXN1; (+) strand; PAM type: YTN; PAM sequence: CTT
tagagagattaaactcagag

SEQ ID NO: 300124 - DNA, 20 bp, Artificial Sequence
  Description of Artificial Sequence: Synthetic oligonucleotide
  Target: ATXN1; (+) strand; PAM type: YTN; PAM sequence: TTT
agagagattaaactcagagt

SEQ ID NO: 300125 - DNA, 20 bp, Artificial Sequence
  Description of Artificial Sequence: Synthetic oligonucleotide
  Target: ATXN1; (+) strand; PAM type: YTN; PAM sequence: TTA
gagagattaaactcagagtt

SEQ ID NO: 300126 - DNA, 20 bp, Artificial Sequence
  Description of Artificial Sequence: Synthetic oligonucleotide
  Target: ATXN1; (+) strand; PAM type: YTN; PAM sequence: TTA
aactcagagttgtagaaaaa

SEQ ID NO: 300127 - DNA, 20 bp, Artificial Sequence
  Description of Artificial Sequence: Synthetic oligonucleotide
  Target: ATXN1; (+) strand; PAM type: YTN; PAM sequence: CTC
agagttgtagaaaaagttta

SEQ ID NO: 300128 - DNA, 20 bp, Artificial Sequence
  Description of Artificial Sequence: Synthetic oligonucleotide
  Target: ATXN1; (+) strand; PAM type: YTN; PAM sequence: TTG
tagaaaaagtttagaaacgg

SEQ ID NO: 300129 - DNA, 20 bp, Artificial Sequence
  Description of Artificial Sequence: Synthetic oligonucleotide
  Target: ATXN1; (+) strand; PAM type: YTN; PAM sequence: TTT
agaaacggatttagaatttc

SEQ ID NO: 300130 - DNA, 20 bp, Artificial Sequence
  Description of Artificial Sequence: Synthetic oligonucleotide
  Target: ATXN1; (+) strand; PAM type: YTN; PAM sequence: TTA
gaaacggatttagaatttcg

SEQ ID NO: 300131 - DNA, 20 bp, Artificial Sequence
  Description of Artificial Sequence: Synthetic oligonucleotide
  Target: ATXN1; (+) strand; PAM type: YTN; PAM sequence: TTT
agaatttcgcaggaaaaaga

SEQ ID NO: 300132 - DNA, 20 bp, Artificial Sequence
  Description of Artificial Sequence: Synthetic oligonucleotide
  Target: ATXN1; (+) strand; PAM type: YTN; PAM sequence: TTA
gaatttcgcaggaaaaagaa

SEQ ID NO: 300133 - DNA, 20 bp, Artificial Sequence
  Description of Artificial Sequence: Synthetic oligonucleotide
  Target: ATXN1; (+) strand; PAM type: YTN; PAM sequence: TTT
cgcaggaaaaagaaaagaca

SEQ ID NO: 300134 - DNA, 20 bp, Artificial Sequence
  Description of Artificial Sequence: Synthetic oligonucleotide
  Target: ATXN1; (+) strand; PAM type: YTN; PAM sequence: TTC
gcaggaaaaagaaaagacag

SEQ ID NO: 300135 - DNA, 20 bp, Artificial Sequence
  Description of Artificial Sequence: Synthetic oligonucleotide
  Target: ATXN1; (+) strand; PAM type: YTN; PAM sequence: CTA
tgaatcagcattttcgtata

SEQ ID NO: 300136 - DNA, 20 bp, Artificial Sequence
  Description of Artificial Sequence: Synthetic oligonucleotide
  Target: ATXN1; (+) strand; PAM type: YTN; PAM sequence: TTT
tcgtataagcagcctggaat

SEQ ID NO: 300137 - DNA, 20 bp, Artificial Sequence
  Description of Artificial Sequence: Synthetic oligonucleotide
  Target: ATXN1; (+) strand; PAM type: YTN; PAM sequence: TTT
cgtataagcagcctggaatc

SEQ ID NO: 300138 - DNA, 20 bp, Artificial Sequence
  Description of Artificial Sequence: Synthetic oligonucleotide
  Target: ATXN1; (+) strand; PAM type: YTN; PAM sequence: TTC
gtataagcagcctggaatca

SEQ ID NO: 300139 - DNA, 20 bp, Artificial Sequence
  Description of Artificial Sequence: Synthetic oligonucleotide
  Target: ATXN1; (+) strand; PAM type: YTN; PAM sequence: CTG
gaatcaaagaagaaatacac

SEQ ID NO: 300140 - DNA, 20 bp, Artificial Sequence
  Description of Artificial Sequence: Synthetic oligonucleotide
  Target: ATXN1; (+) strand; PAM type: YTN; PAM sequence: TTT
agtctgtatatttatattta

SEQ ID NO: 300141 - DNA, 20 bp, Artificial Sequence
  Description of Artificial Sequence: Synthetic oligonucleotide
  Target: ATXN1; (+) strand; PAM type: YTN; PAM sequence: TTA
gtctgtatatttatatttag

SEQ ID NO: 300142 - DNA, 20 bp, Artificial Sequence
  Description of Artificial Sequence: Synthetic oligonucleotide
  Target: ATXN1; (+) strand; PAM type: YTN; PAM sequence: CTG
tatatttatatttagaatac

SEQ ID NO: 300143 - DNA, 20 bp, Artificial Sequence
  Description of Artificial Sequence: Synthetic oligonucleotide
  Target: ATXN1; (+) strand; PAM type: YTN; PAM sequence: TTT
atatttagaatacaaatggc

SEQ ID NO: 300144 - DNA, 20 bp, Artificial Sequence
  Description of Artificial Sequence: Synthetic oligonucleotide
  Target: ATXN1; (+) strand; PAM type: YTN; PAM sequence: TTA
tatttagaatacaaatggct

SEQ ID NO: 300145 - DNA, 20 bp, Artificial Sequence
  Description of Artificial Sequence: Synthetic oligonucleotide
  Target: ATXN1; (+) strand; PAM type: YTN; PAM sequence: TTT
agaatacaaatggcttctac

SEQ ID NO: 300146 - DNA, 20 bp, Artificial Sequence
  Description of Artificial Sequence: Synthetic oligonucleotide
  Target: ATXN1; (+) strand; PAM type: YTN; PAM sequence: TTA
gaatacaaatggcttctacg

SEQ ID NO: 300147 - DNA, 20 bp, Artificial Sequence
  Description of Artificial Sequence: Synthetic oligonucleotide
  Target: ATXN1; (+) strand; PAM type: YTN; PAM sequence: CTT
ctacggtctttttgtgcctt

SEQ ID NO: 300148 - DNA, 20 bp, Artificial Sequence
  Description of Artificial Sequence: Synthetic oligonucleotide
  Target: ATXN1; (+) strand; PAM type: YTN; PAM sequence: TTC
tacggtctttttgtgccttt

SEQ ID NO: 300149 - DNA, 20 bp, Artificial Sequence
  Description of Artificial Sequence: Synthetic oligonucleotide
  Target: ATXN1; (+) strand; PAM type: YTN; PAM sequence: CTA
cggtctttttgtgcctttat

SEQ ID NO: 300150 - DNA, 20 bp, Artificial Sequence
  Description of Artificial Sequence: Synthetic oligonucleotide
  Target: ATXN1; (+) strand; PAM type: YTN; PAM sequence: CTT
tttgtgcctttatcatacct

SEQ ID NO: 300151 - DNA, 20 bp, Artificial Sequence
  Description of Artificial Sequence: Synthetic oligonucleotide
  Target: ATXN1; (+) strand; PAM type: YTN; PAM sequence: TTT
ttgtgcctttatcataccta

SEQ ID NO: 300152 - DNA, 20 bp, Artificial Sequence
  Description of Artificial Sequence: Synthetic oligonucleotide
  Target: ATXN1; (+) strand; PAM type: YTN; PAM sequence: TTT
tgtgcctttatcatacctaa

SEQ ID NO: 300153 - DNA, 20 bp, Artificial Sequence
  Description of Artificial Sequence: Synthetic oligonucleotide
  Target: ATXN1; (+) strand; PAM type: YTN; PAM sequence: TTT
gtgcctttatcatacctaac

SEQ ID NO: 300154 - DNA, 20 bp, Artificial Sequence
  Description of Artificial Sequence: Synthetic oligonucleotide
  Target: ATXN1; (+) strand; PAM type: YTN; PAM sequence: TTG
tgcctttatcatacctaact

SEQ ID NO: 300155 - DNA, 20 bp, Artificial Sequence
  Description of Artificial Sequence: Synthetic oligonucleotide
  Target: ATXN1; (+) strand; PAM type: YTN; PAM sequence: CTT
tatcatacctaactttatct

SEQ ID NO: 300156 - DNA, 20 bp, Artificial Sequence
  Description of Artificial Sequence: Synthetic oligonucleotide
  Target: ATXN1; (+) strand; PAM type: YTN; PAM sequence: TTT
atcatacctaactttatctg

SEQ ID NO: 300157 - DNA, 20 bp, Artificial Sequence
  Description of Artificial Sequence: Synthetic oligonucleotide
  Target: ATXN1; (+) strand; PAM type: YTN; PAM sequence: TTA
tcatacctaactttatctgg

SEQ ID NO: 300158 - DNA, 20 bp, Artificial Sequence
  Description of Artificial Sequence: Synthetic oligonucleotide
  Target: ATXN1; (+) strand; PAM type: YTN; PAM sequence: CTA
actttatctggtactcatag

SEQ ID NO: 300159 - DNA, 20 bp, Artificial Sequence
  Description of Artificial Sequence: Synthetic oligonucleotide
  Target: ATXN1; (+) strand; PAM type: YTN; PAM sequence: CTT
tatctggtactcatagaggt

SEQ ID NO: 300160 - DNA, 20 bp, Artificial Sequence
  Description of Artificial Sequence: Synthetic oligonucleotide
  Target: ATXN1; (+) strand; PAM type: YTN; PAM sequence: TTT
atctggtactcatagaggtc

SEQ ID NO: 300161 - DNA, 20 bp, Artificial Sequence
  Description of Artificial Sequence: Synthetic oligonucleotide
  Target: ATXN1; (+) strand; PAM type: YTN; PAM sequence: TTA
tctggtactcatagaggtca

SEQ ID NO: 300162 - DNA, 20 bp, Artificial Sequence
  Description of Artificial Sequence: Synthetic oligonucleotide
  Target: ATXN1; (+) strand; PAM type: YTN; PAM sequence: CTG
gtactcatagaggtcaccaa

SEQ ID NO: 300163 - DNA, 20 bp, Artificial Sequence
  Description of Artificial Sequence: Synthetic oligonucleotide
  Target: ATXN1; (+) strand; PAM type: YTN; PAM sequence: CTC
atagaggtcaccaaagctgt

SEQ ID NO: 300164 - DNA, 20 bp, Artificial Sequence
  Description of Artificial Sequence: Synthetic oligonucleotide
  Target: ATXN1; (+) strand; PAM type: YTN; PAM sequence: CTG
tataaaatcatagcaaccag

SEQ ID NO: 300165 - DNA, 20 bp, Artificial Sequence
  Description of Artificial Sequence: Synthetic oligonucleotide
  Target: ATXN1; (+) strand; PAM type: YTN; PAM sequence: CTA
aaggaaacaaacacctctgg

SEQ ID NO: 300166 - DNA, 20 bp, Artificial Sequence
  Description of Artificial Sequence: Synthetic oligonucleotide
  Target: ATXN1; (+) strand; PAM type: YTN; PAM sequence: CTC
tggcagaaatcctcaccaaa

SEQ ID NO: 300167 - DNA, 20 bp, Artificial Sequence
  Description of Artificial Sequence: Synthetic oligonucleotide
  Target: ATXN1; (+) strand; PAM type: YTN; PAM sequence: CTG
gcagaaatcctcaccaaaca

SEQ ID NO: 300168 - DNA, 20 bp, Artificial Sequence
  Description of Artificial Sequence: Synthetic oligonucleotide
  Target: ATXN1; (+) strand; PAM type: YTN; PAM sequence: CTC
accaaacaaagtataaggca

SEQ ID NO: 300169 - DNA, 20 bp, Artificial Sequence
  Description of Artificial Sequence: Synthetic oligonucleotide
  Target: ATXN1; (+) strand; PAM type: YTN; PAM sequence: CTA
tactttcattggccactttt

SEQ ID NO: 300170 - DNA, 20 bp, Artificial Sequence
  Description of Artificial Sequence: Synthetic oligonucleotide
  Target: ATXN1; (+) strand; PAM type: YTN; PAM sequence: CTT
tcattggccacttttaacat

SEQ ID NO: 300171 - DNA, 20 bp, Artificial Sequence
  Description of Artificial Sequence: Synthetic oligonucleotide
  Target: ATXN1; (+) strand; PAM type: YTN; PAM sequence: TTT
cattggccacttttaacata

SEQ ID NO: 300172 - DNA, 20 bp, Artificial Sequence
  Description of Artificial Sequence: Synthetic oligonucleotide
  Target: ATXN1; (+) strand; PAM type: YTN; PAM sequence: TTC
attggccacttttaacatag

SEQ ID NO: 300173 - DNA, 20 bp, Artificial Sequence
  Description of Artificial Sequence: Synthetic oligonucleotide
  Target: ATXN1; (+) strand; PAM type: YTN; PAM sequence: TTG
gccacttttaacatagccat

SEQ ID NO: 300174 - DNA, 20 bp, Artificial Sequence
  Description of Artificial Sequence: Synthetic oligonucleotide
  Target: ATXN1; (+) strand; PAM type: YTN; PAM sequence: CTT
ttaacatagccatgcttcta

SEQ ID NO: 300175 - DNA, 20 bp, Artificial Sequence
  Description of Artificial Sequence: Synthetic oligonucleotide
  Target: ATXN1; (+) strand; PAM type: YTN; PAM sequence: TTT
taacatagccatgcttctac

SEQ ID NO: 300176 - DNA, 20 bp, Artificial Sequence
  Description of Artificial Sequence: Synthetic oligonucleotide
  Target: ATXN1; (+) strand; PAM type: YTN; PAM sequence: TTT
aacatagccatgcttctacc

SEQ ID NO: 300177 - DNA, 20 bp, Artificial Sequence
  Description of Artificial Sequence: Synthetic oligonucleotide
  Target: ATXN1; (+) strand; PAM type: YTN; PAM sequence: TTA
acatagccatgcttctacct

SEQ ID NO: 300178 - DNA, 20 bp, Artificial Sequence
  Description of Artificial Sequence: Synthetic oligonucleotide
  Target: ATXN1; (+) strand; PAM type: YTN; PAM sequence: CTT
ctacctgtgaaggtatggga

SEQ ID NO: 300179 - DNA, 20 bp, Artificial Sequence
  Description of Artificial Sequence: Synthetic oligonucleotide
  Target: ATXN1; (+) strand; PAM type: YTN; PAM sequence: TTC
tacctgtgaaggtatgggac

SEQ ID NO: 300180 - DNA, 20 bp, Artificial Sequence
  Description of Artificial Sequence: Synthetic oligonucleotide
  Target: ATXN1; (+) strand; PAM type: YTN; PAM sequence: CTA
cctgtgaaggtatgggacaa

SEQ ID NO: 300181 - DNA, 20 bp, Artificial Sequence
  Description of Artificial Sequence: Synthetic oligonucleotide
  Target: ATXN1; (+) strand; PAM type: YTN; PAM sequence: CTG
tgaaggtatgggacaattcc

SEQ ID NO: 300182 - DNA, 20 bp, Artificial Sequence
  Description of Artificial Sequence: Synthetic oligonucleotide
  Target: ATXN1; (+) strand; PAM type: YTN; PAM sequence: TTC
catgaaaactgagttcacgg

SEQ ID NO: 300183 - DNA, 20 bp, Artificial Sequence
  Description of Artificial Sequence: Synthetic oligonucleotide
  Target: ATXN1; (+) strand; PAM type: YTN; PAM sequence: CTG
agttcacggagggccctcct

SEQ ID NO: 300184 - DNA, 20 bp, Artificial Sequence
  Description of Artificial Sequence: Synthetic oligonucleotide
  Target: ATXN1; (+) strand; PAM type: YTN; PAM sequence: TTC
acggagggccctcctgtggg

SEQ ID NO: 300185 - DNA, 20 bp, Artificial Sequence
  Description of Artificial Sequence: Synthetic oligonucleotide
  Target: ATXN1; (+) strand; PAM type: YTN; PAM sequence: CTC
ctgtgggttatgtatcctgg

SEQ ID NO: 300186 - DNA, 20 bp, Artificial Sequence
  Description of Artificial Sequence: Synthetic oligonucleotide
  Target: ATXN1; (+) strand; PAM type: YTN; PAM sequence: CTG
tgggttatgtatcctgggtt

SEQ ID NO: 300187 - DNA, 20 bp, Artificial Sequence
  Description of Artificial Sequence: Synthetic oligonucleotide
  Target: ATXN1; (+) strand; PAM type: YTN; PAM sequence: TTA
tgtatcctgggttccagcat

SEQ ID NO: 300188 - DNA, 20 bp, Artificial Sequence
  Description of Artificial Sequence: Synthetic oligonucleotide
  Target: ATXN1; (+) strand; PAM type: YTN; PAM sequence: CTG
ggttccagcataacccctgg

SEQ ID NO: 300189 - DNA, 20 bp, Artificial Sequence
  Description of Artificial Sequence: Synthetic oligonucleotide
  Target: ATXN1; (+) strand; PAM type: YTN; PAM sequence: TTC
cagcataacccctggttgag

SEQ ID NO: 300190 - DNA, 20 bp, Artificial Sequence
  Description of Artificial Sequence: Synthetic oligonucleotide
  Target: ATXN1; (+) strand; PAM type: YTN; PAM sequence: CTG
gttgagaacttactattaac

SEQ ID NO: 300191 - DNA, 20 bp, Artificial Sequence
  Description of Artificial Sequence: Synthetic oligonucleotide
  Target: ATXN1; (+) strand; PAM type: YTN; PAM sequence: TTG
agaacttactattaacatta

SEQ ID NO: 300192 - DNA, 20 bp, Artificial Sequence
  Description of Artificial Sequence: Synthetic oligonucleotide
  Target: ATXN1; (+) strand; PAM type: YTN; PAM sequence: CTT
actattaacattagctcttc

SEQ ID NO: 300193 - DNA, 20 bp, Artificial Sequence
  Description of Artificial Sequence: Synthetic oligonucleotide
  Target: ATXN1; (+) strand; PAM type: YTN; PAM sequence: TTA
ctattaacattagctcttca

SEQ ID NO: 300194 - DNA, 20 bp, Artificial Sequence
  Description of Artificial Sequence: Synthetic oligonucleotide
  Target: ATXN1; (+) strand; PAM type: YTN; PAM sequence: CTA
ttaacattagctcttcaatt

SEQ ID NO: 300195 - DNA, 20 bp, Artificial Sequence
  Description of Artificial Sequence: Synthetic oligonucleotide
  Target: ATXN1; (+) strand; PAM type: YTN; PAM sequence: TTA
acattagctcttcaatttat

SEQ ID NO: 300196 - DNA, 20 bp, Artificial Sequence
  Description of Artificial Sequence: Synthetic oligonucleotide
  Target: ATXN1; (+) strand; PAM type: YTN; PAM sequence: TTA
gctcttcaatttattttcat

SEQ ID NO: 300197 - DNA, 20 bp, Artificial Sequence
  Description of Artificial Sequence: Synthetic oligonucleotide
  Target: ATXN1; (+) strand; PAM type: YTN; PAM sequence: CTC
ttcaatttattttcatgatc

SEQ ID NO: 300198 - DNA, 20 bp, Artificial Sequence
  Description of Artificial Sequence: Synthetic oligonucleotide
  Target: ATXN1; (+) strand; PAM type: YTN; PAM sequence: CTT
caatttattttcatgatcca

SEQ ID NO: 300199 - DNA, 20 bp, Artificial Sequence
  Description of Artificial Sequence: Synthetic oligonucleotide
  Target: ATXN1; (+) strand; PAM type: YTN; PAM sequence: TTC
aatttattttcatgatccag

SEQ ID NO: 300200 - DNA, 20 bp, Artificial Sequence
  Description of Artificial Sequence: Synthetic oligonucleotide
  Target: ATXN1; (+) strand; PAM type: YTN; PAM sequence: TTT
attttcatgatccagggact

SEQ ID NO: 300201 - DNA, 20 bp, Artificial Sequence
  Description of Artificial Sequence: Synthetic oligonucleotide
  Target: ATXN1; (+) strand; PAM type: YTN; PAM sequence: TTA
ttttcatgatccagggactt

SEQ ID NO: 300202 - DNA, 20 bp, Artificial Sequence
  Description of Artificial Sequence: Synthetic oligonucleotide
  Target: ATXN1; (+) strand; PAM type: YTN; PAM sequence: TTT
tcatgatccagggacttgtg

SEQ ID NO: 300203 - DNA, 20 bp, Artificial Sequence
  Description of Artificial Sequence: Synthetic oligonucleotide
  Target: ATXN1; (+) strand; PAM type: YTN; PAM sequence: TTT
catgatccagggacttgtgt

SEQ ID NO: 300204 - DNA, 20 bp, Artificial Sequence
  Description of Artificial Sequence: Synthetic oligonucleotide
  Target: ATXN1; (+) strand; PAM type: YTN; PAM sequence: TTC
atgatccagggacttgtgta

SEQ ID NO: 300205 - DNA, 20 bp, Artificial Sequence
  Description of Artificial Sequence: Synthetic oligonucleotide
  Target: ATXN1; (+) strand; PAM type: YTN; PAM sequence: CTT
gtgtatattgtatcacagtg

SEQ ID NO: 300206 - DNA, 20 bp, Artificial Sequence
  Description of Artificial Sequence: Synthetic oligonucleotide
  Target: ATXN1; (+) strand; PAM type: YTN; PAM sequence: TTG
tgtatattgtatcacagtgg

SEQ ID NO: 300207 - DNA, 20 bp, Artificial Sequence
  Description of Artificial Sequence: Synthetic oligonucleotide
  Target: ATXN1; (+) strand; PAM type: YTN; PAM sequence: TTG
tatcacagtggttacctaaa

SEQ ID NO: 300208 - DNA, 20 bp, Artificial Sequence
  Description of Artificial Sequence: Synthetic oligonucleotide
  Target: ATXN1; (+) strand; PAM type: YTN; PAM sequence: TTA
cctaaaataaaaagtaacca

SEQ ID NO: 300209 - DNA, 20 bp, Artificial Sequence
  Description of Artificial Sequence: Synthetic oligonucleotide
  Target: ATXN1; (+) strand; PAM type: YTN; PAM sequence: CTA
aaataaaaagtaaccagata

SEQ ID NO: 300210 - DNA, 20 bp, Artificial Sequence
  Description of Artificial Sequence: Synthetic oligonucleotide
  Target: ATXN1; (+) strand; PAM type: YTN; PAM sequence: TTG
atgaatttccatgagaatga

SEQ ID NO: 300211 - DNA, 20 bp, Artificial Sequence
  Description of Artificial Sequence: Synthetic oligonucleotide
  Target: ATXN1; (+) strand; PAM type: YTN; PAM sequence: TTT
ccatgagaatgagacatatc

SEQ ID NO: 300212 - DNA, 20 bp, Artificial Sequence
  Description of Artificial Sequence: Synthetic oligonucleotide
  Target: ATXN1; (+) strand; PAM type: YTN; PAM sequence: TTC
catgagaatgagacatatca

SEQ ID NO: 300213 - DNA, 20 bp, Artificial Sequence
  Description of Artificial Sequence: Synthetic oligonucleotide
  Target: ATXN1; (+) strand; PAM type: YTN; PAM sequence: TTT
aggagctttacttaaaaacc

SEQ ID NO: 300214 - DNA, 20 bp, Artificial Sequence
  Description of Artificial Sequence: Synthetic oligonucleotide
  Target: ATXN1; (+) strand; PAM type: YTN; PAM sequence: TTA
ggagctttacttaaaaacct

SEQ ID NO: 300215 - DNA, 20 bp, Artificial Sequence
  Description of Artificial Sequence: Synthetic oligonucleotide
  Target: ATXN1; (+) strand; PAM type: YTN; PAM sequence: CTT
tacttaaaaaccttcctgct

SEQ ID NO: 300216 - DNA, 20 bp, Artificial Sequence
  Description of Artificial Sequence: Synthetic oligonucleotide
  Target: ATXN1; (+) strand; PAM type: YTN; PAM sequence: TTT
acttaaaaaccttcctgcta

SEQ ID NO: 300217 - DNA, 20 bp, Artificial Sequence
  Description of Artificial Sequence: Synthetic oligonucleotide
  Target: ATXN1; (+) strand; PAM type: YTN; PAM sequence: TTA
cttaaaaaccttcctgctaa

SEQ ID NO: 300218 - DNA, 20 bp, Artificial Sequence
  Description of Artificial Sequence: Synthetic oligonucleotide
  Target: ATXN1; (+) strand; PAM type: YTN; PAM sequence: CTT
aaaaaccttcctgctaaaca

SEQ ID NO: 300219 - DNA, 20 bp, Artificial Sequence
  Description of Artificial Sequence: Synthetic oligonucleotide
  Target: ATXN1; (+) strand; PAM type: YTN; PAM sequence: TTA
aaaaccttcctgctaaacaa

SEQ ID NO: 300220 - DNA, 20 bp, Artificial Sequence
  Description of Artificial Sequence: Synthetic oligonucleotide
  Target: ATXN1; (+) strand; PAM type: YTN; PAM sequence: CTT
cctgctaaacaaacaaaaaa

SEQ ID NO: 300221 - DNA, 20 bp, Artificial Sequence
  Description of Artificial Sequence: Synthetic oligonucleotide
  Target: ATXN1; (+) strand; PAM type: YTN; PAM sequence: TTC
ctgctaaacaaacaaaaaag

SEQ ID NO: 300222 - DNA, 20 bp, Artificial Sequence
  Description of Artificial Sequence: Synthetic oligonucleotide
  Target: ATXN1; (+) strand; PAM type: YTN; PAM sequence: CTG
ctaaacaaacaaaaaaggac

SEQ ID NO: 300223 - DNA, 20 bp, Artificial Sequence
  Description of Artificial Sequence: Synthetic oligonucleotide
  Target: ATXN1; (+) strand; PAM type: YTN; PAM sequence: CTA
aacaaacaaaaaaggactaa

SEQ ID NO: 300224 - DNA, 20 bp, Artificial Sequence
  Description of Artificial Sequence: Synthetic oligonucleotide
  Target: ATXN1; (+) strand; PAM type: YTN; PAM sequence: CTA
atgcgatatctgtctcttgg

SEQ ID NO: 300225 - DNA, 20 bp, Artificial Sequence
  Description of Artificial Sequence: Synthetic oligonucleotide
  Target: ATXN1; (+) strand; PAM type: YTN; PAM sequence: CTG
tctcttggggtctcccatgc

SEQ ID NO: 300226 - DNA, 20 bp, Artificial Sequence
  Description of Artificial Sequence: Synthetic oligonucleotide
  Target: ATXN1; (+) strand; PAM type: YTN; PAM sequence: CTC
ttggggtctcccatgcttat

SEQ ID NO: 300227 - DNA, 20 bp, Artificial Sequence
  Description of Artificial Sequence: Synthetic oligonucleotide
  Target: ATXN1; (+) strand; PAM type: YTN; PAM sequence: CTT
ggggtctcccatgcttatga

SEQ ID NO: 300228 - DNA, 20 bp, Artificial Sequence
  Description of Artificial Sequence: Synthetic oligonucleotide
  Target: ATXN1; (+) strand; PAM type: YTN; PAM sequence: TTG
gggtctcccatgcttatgaa

SEQ ID NO: 300229 - DNA, 20 bp, Artificial Sequence
  Description of Artificial Sequence: Synthetic oligonucleotide
  Target: ATXN1; (+) strand; PAM type: YTN; PAM sequence: CTC
ccatgcttatgaattgagaa

SEQ ID NO: 300230 - DNA, 20 bp, Artificial Sequence
  Description of Artificial Sequence: Synthetic oligonucleotide
  Target: ATXN1; (+) strand; PAM type: YTN; PAM sequence: CTT
atgaattgagaaaacacact

SEQ ID NO: 300231 - DNA, 20 bp, Artificial Sequence
  Description of Artificial Sequence: Synthetic oligonucleotide
  Target: ATXN1; (+) strand; PAM type: YTN; PAM sequence: TTA
tgaattgagaaaacacactt

SEQ ID NO: 300232 - DNA, 20 bp, Artificial Sequence
  Description of Artificial Sequence: Synthetic oligonucleotide
  Target: ATXN1; (+) strand; PAM type: YTN; PAM sequence: TTG
agaaaacacacttgatataa

SEQ ID NO: 300233 - DNA, 20 bp, Artificial Sequence
  Description of Artificial Sequence: Synthetic oligonucleotide
  Target: ATXN1; (+) strand; PAM type: YTN; PAM sequence: CTT
gatataagtaaatgaagaaa

SEQ ID NO: 300234 - DNA, 20 bp, Artificial Sequence
  Description of Artificial Sequence: Synthetic oligonucleotide
  Target: ATXN1; (+) strand; PAM type: YTN; PAM sequence: TTG
atataagtaaatgaagaaac

SEQ ID NO: 300235 - DNA, 20 bp, Artificial Sequence
  Description of Artificial Sequence: Synthetic oligonucleotide
  Target: ATXN1; (+) strand; PAM type: YTN; PAM sequence: TTG
aaacagccctgaagtgacag

SEQ ID NO: 300236 - DNA, 20 bp, Artificial Sequence
  Description of Artificial Sequence: Synthetic oligonucleotide
  Target: ATXN1; (+) strand; PAM type: YTN; PAM sequence: CTG
aagtgacagaaaaaatggaa

SEQ ID NO: 300237 - DNA, 20 bp, Artificial Sequence
  Description of Artificial Sequence: Synthetic oligonucleotide
  Target: ATXN1; (+) strand; PAM type: YTN; PAM sequence: TTC
taagctcaactccagaggca

SEQ ID NO: 300238 - DNA, 20 bp, Artificial Sequence
  Description of Artificial Sequence: Synthetic oligonucleotide
  Target: ATXN1; (+) strand; PAM type: YTN; PAM sequence: CTA
agctcaactccagaggcaag

SEQ ID NO: 300239 - DNA, 20 bp, Artificial Sequence
  Description of Artificial Sequence: Synthetic oligonucleotide
  Target: ATXN1; (+) strand; PAM type: YTN; PAM sequence: CTC
aactccagaggcaaggtggt

SEQ ID NO: 300240 - DNA, 20 bp, Artificial Sequence
  Description of Artificial Sequence: Synthetic oligonucleotide
  Target: ATXN1; (+) strand; PAM type: YTN; PAM sequence: CTC
cagaggcaaggtggtacaga

SEQ ID NO: 300241 - DNA, 20 bp, Artificial Sequence
  Description of Artificial Sequence: Synthetic oligonucleotide
  Target: ATXN1; (+) strand; PAM type: YTN; PAM sequence: CTG
gatgaacagttcaaagcttc

SEQ ID NO: 300242 - DNA, 20 bp, Artificial Sequence
  Description of Artificial Sequence: Synthetic oligonucleotide
  Target: ATXN1; (+) strand; PAM type: YTN; PAM sequence: TTC
aaagcttccctagttgaggg

SEQ ID NO: 300243 - DNA, 20 bp, Artificial Sequence
  Description of Artificial Sequence: Synthetic oligonucleotide
  Target: ATXN1; (+) strand; PAM type: YTN; PAM sequence: CTT
ccctagttgagggtctctac

SEQ ID NO: 300244 - DNA, 20 bp, Artificial Sequence
  Description of Artificial Sequence: Synthetic oligonucleotide
  Target: ATXN1; (+) strand; PAM type: YTN; PAM sequence: TTC
cctagttgagggtctctacc

SEQ ID NO: 300245 - DNA, 20 bp, Artificial Sequence
  Description of Artificial Sequence: Synthetic oligonucleotide
  Target: ATXN1; (+) strand; PAM type: YTN; PAM sequence: CTA
gttgagggtctctacctcaa

SEQ ID NO: 300246 - DNA, 20 bp, Artificial Sequence
  Description of Artificial Sequence: Synthetic oligonucleotide
  Target: ATXN1; (+) strand; PAM type: YTN; PAM sequence: TTG
agggtctctacctcaatgac

SEQ ID NO: 300247 - DNA, 20 bp, Artificial Sequence
  Description of Artificial Sequence: Synthetic oligonucleotide
  Target: ATXN1; (+) strand; PAM type: YTN; PAM sequence: CTC
tacctcaatgacagacaaaa

SEQ ID NO: 300248 - DNA, 20 bp, Artificial Sequence
  Description of Artificial Sequence: Synthetic oligonucleotide
  Target: ATXN1; (+) strand; PAM type: YTN; PAM sequence: CTA
cctcaatgacagacaaaact

SEQ ID NO: 300249 - DNA, 20 bp, Artificial Sequence
  Description of Artificial Sequence: Synthetic oligonucleotide
  Target: ATXN1; (+) strand; PAM type: YTN; PAM sequence: CTC
aatgacagacaaaactccta

SEQ ID NO: 300250 - DNA, 20 bp, Artificial Sequence
  Description of Artificial Sequence: Synthetic oligonucleotide
  Target: ATXN1; (+) strand; PAM type: YTN; PAM sequence: CTC
ctaactttggctttctccat

SEQ ID NO: 300251 - DNA, 20 bp, Artificial Sequence
  Description of Artificial Sequence: Synthetic oligonucleotide
  Target: ATXN1; (+) strand; PAM type: YTN; PAM sequence: CTA
actttggctttctccataga

SEQ ID NO: 300252 - DNA, 20 bp, Artificial Sequence
  Description of Artificial Sequence: Synthetic oligonucleotide
  Target: ATXN1; (+) strand; PAM type: YTN; PAM sequence: CTT
tggctttctccatagagcat

SEQ ID NO: 300253 - DNA, 20 bp, Artificial Sequence
  Description of Artificial Sequence: Synthetic oligonucleotide
  Target: ATXN1; (+) strand; PAM type: YTN; PAM sequence: TTT
ggctttctccatagagcatc

SEQ ID NO: 300254 - DNA, 20 bp, Artificial Sequence
  Description of Artificial Sequence: Synthetic oligonucleotide
  Target: ATXN1; (+) strand; PAM type: YTN; PAM sequence: TTG
gctttctccatagagcatca

SEQ ID NO: 300255 - DNA, 20 bp, Artificial Sequence
  Description of Artificial Sequence: Synthetic oligonucleotide
  Target: ATXN1; (+) strand; PAM type: YTN; PAM sequence: CTT
tctccatagagcatcaacca

SEQ ID NO: 300256 - DNA, 20 bp, Artificial Sequence
  Description of Artificial Sequence: Synthetic oligonucleotide
  Target: ATXN1; (+) strand; PAM type: YTN; PAM sequence: TTT
ctccatagagcatcaaccaa

SEQ ID NO: 300257 - DNA, 20 bp, Artificial Sequence
  Description of Artificial Sequence: Synthetic oligonucleotide
  Target: ATXN1; (+) strand; PAM type: YTN; PAM sequence: TTC
tccatagagcatcaaccaaa

SEQ ID NO: 300258 - DNA, 20 bp, Artificial Sequence
  Description of Artificial Sequence: Synthetic oligonucleotide
  Target: ATXN1; (+) strand; PAM type: YTN; PAM sequence: CTC
catagagcatcaaccaaatt

SEQ ID NO: 300259 - DNA, 20 bp, Artificial Sequence
  Description of Artificial Sequence: Synthetic oligonucleotide
  Target: ATXN1; (+) strand; PAM type: YTN; PAM sequence: TTC
agtaatgatgaagtacctgc

SEQ ID NO: 300260 - DNA, 20 bp, Artificial Sequence
  Description of Artificial Sequence: Synthetic oligonucleotide
  Target: ATXN1; (+) strand; PAM type: YTN; PAM sequence: CTG
cttaacactataggttgaat

SEQ ID NO: 300261 - DNA, 20 bp, Artificial Sequence
  Description of Artificial Sequence: Synthetic oligonucleotide
  Target: ATXN1; (+) strand; PAM type: YTN; PAM sequence: CTT
aacactataggttgaataac

SEQ ID NO: 300262 - DNA, 20 bp, Artificial Sequence
  Description of Artificial Sequence: Synthetic oligonucleotide
  Target: ATXN1; (+) strand; PAM type: YTN; PAM sequence: TTA
acactataggttgaataact

SEQ ID NO: 300263 - DNA, 20 bp, Artificial Sequence
  Description of Artificial Sequence: Synthetic oligonucleotide
  Target: ATXN1; (+) strand; PAM type: YTN; PAM sequence: CTA
taggttgaataacttttgac

SEQ ID NO: 300264 - DNA, 20 bp, Artificial Sequence
  Description of Artificial Sequence: Synthetic oligonucleotide
  Target: ATXN1; (+) strand; PAM type: YTN; PAM sequence: TTG
aataacttttgacaagctgt

SEQ ID NO: 300265 - DNA, 20 bp, Artificial Sequence
  Description of Artificial Sequence: Synthetic oligonucleotide
  Target: ATXN1; (+) strand; PAM type: YTN; PAM sequence: CTT
ttgacaagctgtaacatcct

SEQ ID NO: 300266 - DNA, 20 bp, Artificial Sequence
  Description of Artificial Sequence: Synthetic oligonucleotide
  Target: ATXN1; (+) strand; PAM type: YTN; PAM sequence: TTT
tgacaagctgtaacatcctg

SEQ ID NO: 300267 - DNA, 20 bp, Artificial Sequence
  Description of Artificial Sequence: Synthetic oligonucleotide
  Target: ATXN1; (+) strand; PAM type: YTN; PAM sequence: TTT
gacaagctgtaacatcctgt

SEQ ID NO: 300268 - DNA, 20 bp, Artificial Sequence
  Description of Artificial Sequence: Synthetic oligonucleotide
  Target: ATXN1; (+) strand; PAM type: YTN; PAM sequence: TTG
acaagctgtaacatcctgtt

SEQ ID NO: 300269 - DNA, 20 bp, Artificial Sequence
  Description of Artificial Sequence: Synthetic oligonucleotide
  Target: ATXN1; (+) strand; PAM type: YTN; PAM sequence: CTG
taacatcctgttggtggaaa

SEQ ID NO: 300270 - DNA, 20 bp, Artificial Sequence
  Description of Artificial Sequence: Synthetic oligonucleotide
  Target: ATXN1; (+) strand; PAM type: YTN; PAM sequence: CTG
ttggtggaaaatagccagcc

SEQ ID NO: 300271 - DNA, 20 bp, Artificial Sequence
  Description of Artificial Sequence: Synthetic oligonucleotide
  Target: ATXN1; (+) strand; PAM type: YTN; PAM sequence: TTG
gtggaaaatagccagccttg

SEQ ID NO: 300272 - DNA, 20 bp, Artificial Sequence
  Description of Artificial Sequence: Synthetic oligonucleotide
  Target: ATXN1; (+) strand; PAM type: YTN; PAM sequence: CTT
gctcaacataatattgcaaa

SEQ ID NO: 300273 - DNA, 20 bp, Artificial Sequence
  Description of Artificial Sequence: Synthetic oligonucleotide
  Target: ATXN1; (+) strand; PAM type: YTN; PAM sequence: TTG
ctcaacataatattgcaaac

SEQ ID NO: 300274 - DNA, 20 bp, Artificial Sequence
  Description of Artificial Sequence: Synthetic oligonucleotide
  Target: ATXN1; (+) strand; PAM type: YTN; PAM sequence: CTC
aacataatattgcaaaccca

SEQ ID NO: 300275 - DNA, 20 bp, Artificial Sequence
  Description of Artificial Sequence: Synthetic oligonucleotide
  Target: ATXN1; (+) strand; PAM type: YTN; PAM sequence: TTG
caaacccaaaacagggtaat

SEQ ID NO: 300276 - DNA, 20 bp, Artificial Sequence
  Description of Artificial Sequence: Synthetic oligonucleotide
  Target: ATXN1; (+) strand; PAM type: YTN; PAM sequence: TTG
tgcaaagagagaattttgtg

SEQ ID NO: 300277 - DNA, 20 bp, Artificial Sequence
  Description of Artificial Sequence: Synthetic oligonucleotide
  Target: ATXN1; (+) strand; PAM type: YTN; PAM sequence: TTT
tgtgtatgtcccctttccag

SEQ ID NO: 300278 - DNA, 20 bp, Artificial Sequence
  Description of Artificial Sequence: Synthetic oligonucleotide
  Target: ATXN1; (+) strand; PAM type: YTN; PAM sequence: TTT
gtgtatgtcccctttccaga

SEQ ID NO: 300279 - DNA, 20 bp, Artificial Sequence
  Description of Artificial Sequence: Synthetic oligonucleotide
  Target: ATXN1; (+) strand; PAM type: YTN; PAM sequence: TTG
tgtatgtcccctttccagaa

SEQ ID NO: 300280 - DNA, 20 bp, Artificial Sequence
  Description of Artificial Sequence: Synthetic oligonucleotide
  Target: ATXN1; (+) strand; PAM type: YTN; PAM sequence: CTT
tccagaaaatattctgggtg

SEQ ID NO: 300281 - DNA, 20 bp, Artificial Sequence
  Description of Artificial Sequence: Synthetic oligonucleotide
  Target: ATXN1; (+) strand; PAM type: YTN; PAM sequence: TTT
ccagaaaatattctgggtga

SEQ ID NO: 300282 - DNA, 20 bp, Artificial Sequence
  Description of Artificial Sequence: Synthetic oligonucleotide
  Target: ATXN1; (+) strand; PAM type: YTN; PAM sequence: TTC
cagaaaatattctgggtgac

SEQ ID NO: 300283 - DNA, 20 bp, Artificial Sequence
  Description of Artificial Sequence: Synthetic oligonucleotide
  Target: ATXN1; (+) strand; PAM type: YTN; PAM sequence: TTC
tgggtgacatccaatctgct

SEQ ID NO: 300284 - DNA, 20 bp, Artificial Sequence
  Description of Artificial Sequence: Synthetic oligonucleotide
  Target: ATXN1; (+) strand; PAM type: YTN; PAM sequence: CTG
ggtgacatccaatctgcttt

SEQ ID NO: 300285 - DNA, 20 bp, Artificial Sequence
  Description of Artificial Sequence: Synthetic oligonucleotide
  Target: ATXN1; (+) strand; PAM type: YTN; PAM sequence: CTG
cttttacccggctcacttat

SEQ ID NO: 300286 - DNA, 20 bp, Artificial Sequence
  Description of Artificial Sequence: Synthetic oligonucleotide
  Target: ATXN1; (+) strand; PAM type: YTN; PAM sequence: CTT
ttacccggctcacttattta

SEQ ID NO: 300287 - DNA, 20 bp, Artificial Sequence
  Description of Artificial Sequence: Synthetic oligonucleotide
  Target: ATXN1; (+) strand; PAM type: YTN; PAM sequence: TTT
tacccggctcacttatttac

SEQ ID NO: 300288 - DNA, 20 bp, Artificial Sequence
  Description of Artificial Sequence: Synthetic oligonucleotide
  Target: ATXN1; (+) strand; PAM type: YTN; PAM sequence: TTT
acccggctcacttatttaca

SEQ ID NO: 300289 - DNA, 20 bp, Artificial Sequence
  Description of Artificial Sequence: Synthetic oligonucleotide
  Target: ATXN1; (+) strand; PAM type: YTN; PAM sequence: TTA
cccggctcacttatttacaa

SEQ ID NO: 300290 - DNA, 20 bp, Artificial Sequence
  Description of Artificial Sequence: Synthetic oligonucleotide
  Target: ATXN1; (+) strand; PAM type: YTN; PAM sequence: CTC
acttatttacaattggggct

SEQ ID NO: 300291 - DNA, 20 bp, Artificial Sequence
  Description of Artificial Sequence: Synthetic oligonucleotide
  Target: ATXN1; (+) strand; PAM type: YTN; PAM sequence: CTT
atttacaattggggctgcct

SEQ ID NO: 300292 - DNA, 20 bp, Artificial Sequence
  Description of Artificial Sequence: Synthetic oligonucleotide
  Target: ATXN1; (+) strand; PAM type: YTN; PAM sequence: TTA
tttacaattggggctgccta

SEQ ID NO: 300293 - DNA, 20 bp, Artificial Sequence
  Description of Artificial Sequence: Synthetic oligonucleotide
  Target: ATXN1; (+) strand; PAM type: YTN; PAM sequence: TTT
acaattggggctgcctaaaa

SEQ ID NO: 300294 - DNA, 20 bp, Artificial Sequence
  Description of Artificial Sequence: Synthetic oligonucleotide
  Target: ATXN1; (+) strand; PAM type: YTN; PAM sequence: TTA
caattggggctgcctaaaat

SEQ ID NO: 300295 - DNA, 20 bp, Artificial Sequence
  Description of Artificial Sequence: Synthetic oligonucleotide
  Target: ATXN1; (+) strand; PAM type: YTN; PAM sequence: TTG
gggctgcctaaaatgcaatg

SEQ ID NO: 300296 - DNA, 20 bp, Artificial Sequence
  Description of Artificial Sequence: Synthetic oligonucleotide
  Target: ATXN1; (+) strand; PAM type: YTN; PAM sequence: CTG
cctaaaatgcaatgccattc

SEQ ID NO: 300297 - DNA, 20 bp, Artificial Sequence
  Description of Artificial Sequence: Synthetic oligonucleotide
  Target: ATXN1; (+) strand; PAM type: YTN; PAM sequence: CTA
aaatgcaatgccattctaaa

SEQ ID NO: 300298 - DNA, 20 bp, Artificial Sequence
  Description of Artificial Sequence: Synthetic oligonucleotide
  Target: ATXN1; (+) strand; PAM type: YTN; PAM sequence: TTC
taaaactaccaataaactat

SEQ ID NO: 300299 - DNA, 20 bp, Artificial Sequence
  Description of Artificial Sequence: Synthetic oligonucleotide
  Target: ATXN1; (+) strand; PAM type: YTN; PAM sequence: CTA
aaactaccaataaactattt

SEQ ID NO: 300300 - DNA, 20 bp, Artificial Sequence
  Description of Artificial Sequence: Synthetic oligonucleotide
  Target: ATXN1; (+) strand; PAM type: YTN; PAM sequence: CTA
ccaataaactattttgtgaa

SEQ ID NO: 300301 - DNA, 20 bp, Artificial Sequence
  Description of Artificial Sequence: Synthetic oligonucleotide
  Target: ATXN1; (+) strand; PAM type: YTN; PAM sequence: CTA
ttttgtgaaatcaagtttag

SEQ ID NO: 300302 - DNA, 20 bp, Artificial Sequence
  Description of Artificial Sequence: Synthetic oligonucleotide
  Target: ATXN1; (+) strand; PAM type: YTN; PAM sequence: TTT
tgtgaaatcaagtttagtaa

SEQ ID NO: 300303 - DNA, 20 bp, Artificial Sequence
  Description of Artificial Sequence: Synthetic oligonucleotide
  Target: ATXN1; (+) strand; PAM type: YTN; PAM sequence: TTT
gtgaaatcaagtttagtaac

SEQ ID NO: 300304 - DNA, 20 bp, Artificial Sequence
  Description of Artificial Sequence: Synthetic oligonucleotide
  Target: ATXN1; (+) strand; PAM type: YTN; PAM sequence: TTG
tgaaatcaagtttagtaact

SEQ ID NO: 300305 - DNA, 20 bp, Artificial Sequence
  Description of Artificial Sequence: Synthetic oligonucleotide
  Target: ATXN1; (+) strand; PAM type: YTN; PAM sequence: TTT
agtaacttgagattctcatt

SEQ ID NO: 300306 - DNA, 20 bp, Artificial Sequence
  Description of Artificial Sequence: Synthetic oligonucleotide
  Target: ATXN1; (+) strand; PAM type: YTN; PAM sequence: TTA
gtaacttgagattctcattt

SEQ ID NO: 300307 - DNA, 20 bp, Artificial Sequence
  Description of Artificial Sequence: Synthetic oligonucleotide
  Target: ATXN1; (+) strand; PAM type: YTN; PAM sequence: CTT
gagattctcatttatgatat

SEQ ID NO: 300308 - DNA, 20 bp, Artificial Sequence
  Description of Artificial Sequence: Synthetic oligonucleotide
  Target: ATXN1; (+) strand; PAM type: YTN; PAM sequence: TTG
agattctcatttatgatatc

SEQ ID NO: 300309 - DNA, 20 bp, Artificial Sequence
  Description of Artificial Sequence: Synthetic oligonucleotide
  Target: ATXN1; (+) strand; PAM type: YTN; PAM sequence: TTC
tcatttatgatatccctgac

SEQ ID NO: 300310 - DNA, 20 bp, Artificial Sequence
  Description of Artificial Sequence: Synthetic oligonucleotide
  Target: ATXN1; (+) strand; PAM type: YTN; PAM sequence: CTC
atttatgatatccctgacaa

SEQ ID NO: 300311 - DNA, 20 bp, Artificial Sequence
  Description of Artificial Sequence: Synthetic oligonucleotide
  Target: ATXN1; (+) strand; PAM type: YTN; PAM sequence: TTT
atgatatccctgacaaccac

SEQ ID NO: 300312 - DNA, 20 bp, Artificial Sequence
  Description of Artificial Sequence: Synthetic oligonucleotide
  Target: ATXN1; (+) strand; PAM type: YTN; PAM sequence: TTA
tgatatccctgacaaccacc

SEQ ID NO: 300313 - DNA, 20 bp, Artificial Sequence
  Description of Artificial Sequence: Synthetic oligonucleotide
  Target: ATXN1; (+) strand; PAM type: YTN; PAM sequence: CTG
acaaccaccaaaacctgatt

SEQ ID NO: 300314 - DNA, 20 bp, Artificial Sequence
  Description of Artificial Sequence: Synthetic oligonucleotide
  Target: ATXN1; (+) strand; PAM type: YTN; PAM sequence: CTG
attagacatctctctccttt

SEQ ID NO: 300315 - DNA, 20 bp, Artificial Sequence
  Description of Artificial Sequence: Synthetic oligonucleotide
  Target: ATXN1; (+) strand; PAM type: YTN; PAM sequence: TTA
gacatctctctcctttgtct

SEQ ID NO: 300316 - DNA, 20 bp, Artificial Sequence
  Description of Artificial Sequence: Synthetic oligonucleotide
  Target: ATXN1; (+) strand; PAM type: YTN; PAM sequence: CTC
tctcctttgtctaggtgctt

SEQ ID NO: 300317 - DNA, 20 bp, Artificial Sequence
  Description of Artificial Sequence: Synthetic oligonucleotide
  Target: ATXN1; (+) strand; PAM type: YTN; PAM sequence: CTC
tcctttgtctaggtgcttta

SEQ ID NO: 300318 - DNA, 20 bp, Artificial Sequence
  Description of Artificial Sequence: Synthetic oligonucleotide
  Target: ATXN1; (+) strand; PAM type: YTN; PAM sequence: CTC
ctttgtctaggtgctttact

SEQ ID NO: 300319 - DNA, 20 bp, Artificial Sequence
  Description of Artificial Sequence: Synthetic oligonucleotide
  Target: ATXN1; (+) strand; PAM type: YTN; PAM sequence: CTT
tgtctaggtgctttactgaa

SEQ ID NO: 300320 - DNA, 20 bp, Artificial Sequence
  Description of Artificial Sequence: Synthetic oligonucleotide
  Target: ATXN1; (+) strand; PAM type: YTN; PAM sequence: TTT
gtctaggtgctttactgaaa

SEQ ID NO: 300321 - DNA, 20 bp, Artificial Sequence
  Description of Artificial Sequence: Synthetic oligonucleotide
  Target: ATXN1; (+) strand; PAM type: YTN; PAM sequence: TTG
tctaggtgctttactgaaaa

SEQ ID NO: 300322 - DNA, 20 bp, Artificial Sequence
  Description of Artificial Sequence: Synthetic oligonucleotide
  Target: ATXN1; (+) strand; PAM type: YTN; PAM sequence: CTA
ggtgctttactgaaaaaaag

SEQ ID NO: 300323 - DNA, 20 bp, Artificial Sequence
  Description of Artificial Sequence: Synthetic oligonucleotide
  Target: ATXN1; (+) strand; PAM type: YTN; PAM sequence: CTT
tactgaaaaaaagcatggaa

SEQ ID NO: 300324 - DNA, 20 bp, Artificial Sequence
  Description of Artificial Sequence: Synthetic oligonucleotide
  Target: ATXN1; (+) strand; PAM type: YTN; PAM sequence: TTT
actgaaaaaaagcatggaaa

SEQ ID NO: 300325 - DNA, 20 bp, Artificial Sequence
  Description of Artificial Sequence: Synthetic oligonucleotide
  Target: ATXN1; (+) strand; PAM type: YTN; PAM sequence: TTA
ctgaaaaaaagcatggaaat

SEQ ID NO: 300326 - DNA, 20 bp, Artificial Sequence
  Description of Artificial Sequence: Synthetic oligonucleotide
  Target: ATXN1; (+) strand; PAM type: YTN; PAM sequence: CTG
aaaaaaagcatggaaataga

SEQ ID NO: 300327 - DNA, 20 bp, Artificial Sequence
  Description of Artificial Sequence: Synthetic oligonucleotide
  Target: ATXN1; (+) strand; PAM type: YTN; PAM sequence: CTT
ggagatgcatgtgtgtgtat

SEQ ID NO: 300328 - DNA, 20 bp, Artificial Sequence
  Description of Artificial Sequence: Synthetic oligonucleotide
  Target: ATXN1; (+) strand; PAM type: YTN; PAM sequence: TTG
gagatgcatgtgtgtgtatg

SEQ ID NO: 300329 - DNA, 20 bp, Artificial Sequence
  Description of Artificial Sequence: Synthetic oligonucleotide
  Target: ATXN1; (+) strand; PAM type: YTN; PAM sequence: TTG
catgtgtatgtacatatata

SEQ ID NO: 300330 - DNA, 20 bp, Artificial Sequence
  Description of Artificial Sequence: Synthetic oligonucleotide
  Target: ATXN1; (+) strand; PAM type: YTN; PAM sequence: CTC
tgtgtgtgtgtatgtgtgtg

SEQ ID NO: 300331 - DNA, 20 bp, Artificial Sequence
  Description of Artificial Sequence: Synthetic oligonucleotide
  Target: ATXN1; (+) strand; PAM type: YTN; PAM sequence: CTG
tgtgtgtgtatgtgtgtgtg

SEQ ID NO: 300332 - DNA, 20 bp, Artificial Sequence
  Description of Artificial Sequence: Synthetic oligonucleotide
  Target: ATXN1; (+) strand; PAM type: YTN; PAM sequence: TTT
aaacacactgcttttcctat

SEQ ID NO: 300333 - DNA, 20 bp, Artificial Sequence
  Description of Artificial Sequence: Synthetic oligonucleotide
  Target: ATXN1; (+) strand; PAM type: YTN; PAM sequence: TTA
aacacactgcttttcctata

SEQ ID NO: 300334 - DNA, 20 bp, Artificial Sequence
  Description of Artificial Sequence: Synthetic oligonucleotide
  Target: ATXN1; (+) strand; PAM type: YTN; PAM sequence: CTG
cttttcctatatgcagcagg

SEQ ID NO: 300335 - DNA, 20 bp, Artificial Sequence
  Description of Artificial Sequence: Synthetic oligonucleotide
  Target: ATXN1; (+) strand; PAM type: YTN; PAM sequence: CTT
ttcctatatgcagcaggaat

SEQ ID NO: 300336 - DNA, 20 bp, Artificial Sequence
  Description of Artificial Sequence: Synthetic oligonucleotide
  Target: ATXN1; (+) strand; PAM type: YTN; PAM sequence: TTT
tcctatatgcagcaggaatt

SEQ ID NO: 300337 - DNA, 20 bp, Artificial Sequence
  Description of Artificial Sequence: Synthetic oligonucleotide
  Target: ATXN1; (+) strand; PAM type: YTN; PAM sequence: TTT
cctatatgcagcaggaattt

SEQ ID NO: 300338 - DNA, 20 bp, Artificial Sequence
  Description of Artificial Sequence: Synthetic oligonucleotide
  Target: ATXN1; (+) strand; PAM type: YTN; PAM sequence: TTC
ctatatgcagcaggaatttc

SEQ ID NO: 300339 - DNA, 20 bp, Artificial Sequence
  Description of Artificial Sequence: Synthetic oligonucleotide
  Target: ATXN1; (+) strand; PAM type: YTN; PAM sequence: CTA
tatgcagcaggaatttccta

SEQ ID NO: 300340 - DNA, 20 bp, Artificial Sequence
  Description of Artificial Sequence: Synthetic oligonucleotide
  Target: ATXN1; (+) strand; PAM type: YTN; PAM sequence: TTT
cctatctggcatatgaagac

SEQ ID NO: 300341 - DNA, 20 bp, Artificial Sequence
  Description of Artificial Sequence: Synthetic oligonucleotide
  Target: ATXN1; (+) strand; PAM type: YTN; PAM sequence: TTC
ctatctggcatatgaagaca

SEQ ID NO: 300342 - DNA, 20 bp, Artificial Sequence
  Description of Artificial Sequence: Synthetic oligonucleotide
  Target: ATXN1; (+) strand; PAM type: YTN; PAM sequence: CTA
tctggcatatgaagacaata

SEQ ID NO: 300343 - DNA, 20 bp, Artificial Sequence
  Description of Artificial Sequence: Synthetic oligonucleotide
  Target: ATXN1; (+) strand; PAM type: YTN; PAM sequence: CTG
gcatatgaagacaatacata

SEQ ID NO: 300344 - DNA, 20 bp, Artificial Sequence
  Description of Artificial Sequence: Synthetic oligonucleotide
  Target: ATXN1; (+) strand; PAM type: YTN; PAM sequence: CTC
ttttggatggagctggtgag

SEQ ID NO: 300345 - DNA, 20 bp, Artificial Sequence
  Description of Artificial Sequence: Synthetic oligonucleotide
  Target: ATXN1; (+) strand; PAM type: YTN; PAM sequence: CTT
ttggatggagctggtgagtc

SEQ ID NO: 300346 - DNA, 20 bp, Artificial Sequence
  Description of Artificial Sequence: Synthetic oligonucleotide
  Target: ATXN1; (+) strand; PAM type: YTN; PAM sequence: TTT
tggatggagctggtgagtca

SEQ ID NO: 300347 - DNA, 20 bp, Artificial Sequence
  Description of Artificial Sequence: Synthetic oligonucleotide
  Target: ATXN1; (+) strand; PAM type: YTN; PAM sequence: TTT
ggatggagctggtgagtcag

SEQ ID NO: 300348 - DNA, 20 bp, Artificial Sequence
  Description of Artificial Sequence: Synthetic oligonucleotide
  Target: ATXN1; (+) strand; PAM type: YTN; PAM sequence: TTG
gatggagctggtgagtcagg

SEQ ID NO: 300349 - DNA, 20 bp, Artificial Sequence
  Description of Artificial Sequence: Synthetic oligonucleotide
  Target: ATXN1; (+) strand; PAM type: YTN; PAM sequence: CTG
gtgagtcaggcagtgttttg

SEQ ID NO: 300350 - DNA, 20 bp, Artificial Sequence
  Description of Artificial Sequence: Synthetic oligonucleotide
  Target: ATXN1; (+) strand; PAM type: YTN; PAM sequence: TTT
tggaactgcaatacttgagt

SEQ ID NO: 300351 - DNA, 20 bp, Artificial Sequence
  Description of Artificial Sequence: Synthetic oligonucleotide
  Target: ATXN1; (+) strand; PAM type: YTN; PAM sequence: TTT
ggaactgcaatacttgagtc

SEQ ID NO: 300352 - DNA, 20 bp, Artificial Sequence
  Description of Artificial Sequence: Synthetic oligonucleotide
  Target: ATXN1; (+) strand; PAM type: YTN; PAM sequence: TTG
gaactgcaatacttgagtct

SEQ ID NO: 300353 - DNA, 20 bp, Artificial Sequence
  Description of Artificial Sequence: Synthetic oligonucleotide
  Target: ATXN1; (+) strand; PAM type: YTN; PAM sequence: CTG
caatacttgagtctgcatga

SEQ ID NO: 300354 - DNA, 20 bp, Artificial Sequence
  Description of Artificial Sequence: Synthetic oligonucleotide
  Target: ATXN1; (+) strand; PAM type: YTN; PAM sequence: CTT
gagtctgcatgactcatgag

SEQ ID NO: 300355 - DNA, 20 bp, Artificial Sequence
  Description of Artificial Sequence: Synthetic oligonucleotide
  Target: ATXN1; (+) strand; PAM type: YTN; PAM sequence: TTG
agtctgcatgactcatgagg

SEQ ID NO: 300356 - DNA, 20 bp, Artificial Sequence
  Description of Artificial Sequence: Synthetic oligonucleotide
  Target: ATXN1; (+) strand; PAM type: YTN; PAM sequence: CTG
catgactcatgaggaaagca

SEQ ID NO: 300357 - DNA, 20 bp, Artificial Sequence
  Description of Artificial Sequence: Synthetic oligonucleotide
  Target: ATXN1; (+) strand; PAM type: YTN; PAM sequence: CTC
atgaggaaagcaagtctggg

SEQ ID NO: 300358 - DNA, 20 bp, Artificial Sequence
  Description of Artificial Sequence: Synthetic oligonucleotide
  Target: ATXN1; (+) strand; PAM type: YTN; PAM sequence: CTG
gggtctgggactgttgtatc

SEQ ID NO: 300359 - DNA, 20 bp, Artificial Sequence
  Description of Artificial Sequence: Synthetic oligonucleotide
  Target: ATXN1; (+) strand; PAM type: YTN; PAM sequence: CTG
ggactgttgtatcaaaatgg

SEQ ID NO: 300360 - DNA, 20 bp, Artificial Sequence
  Description of Artificial Sequence: Synthetic oligonucleotide
  Target: ATXN1; (+) strand; PAM type: YTN; PAM sequence: CTG
ttgtatcaaaatgggaagga

SEQ ID NO: 300361 - DNA, 20 bp, Artificial Sequence
  Description of Artificial Sequence: Synthetic oligonucleotide
  Target: ATXN1; (+) strand; PAM type: YTN; PAM sequence: TTG
tatcaaaatgggaaggagtg

SEQ ID NO: 300362 - DNA, 20 bp, Artificial Sequence
  Description of Artificial Sequence: Synthetic oligonucleotide
  Target: ATXN1; (+) strand; PAM type: YTN; PAM sequence: CTT
tttataatttaaatttttat

SEQ ID NO: 300363 - DNA, 20 bp, Artificial Sequence
  Description of Artificial Sequence: Synthetic oligonucleotide
  Target: ATXN1; (+) strand; PAM type: YTN; PAM sequence: TTT
ttataatttaaatttttatt

SEQ ID NO: 300364 - DNA, 20 bp, Artificial Sequence
  Description of Artificial Sequence: Synthetic oligonucleotide
  Target: ATXN1; (+) strand; PAM type: YTN; PAM sequence: TTT
tataatttaaatttttattt

SEQ ID NO: 300365 - DNA, 20 bp, Artificial Sequence
  Description of Artificial Sequence: Synthetic oligonucleotide
  Target: ATXN1; (+) strand; PAM type: YTN; PAM sequence: TTT
ataatttaaatttttatttt

SEQ ID NO: 300366 - DNA, 20 bp, Artificial Sequence
  Description of Artificial Sequence: Synthetic oligonucleotide
  Target: ATXN1; (+) strand; PAM type: YTN; PAM sequence: TTA
taatttaaatttttattttt

SEQ ID NO: 300367 - DNA, 20 bp, Artificial Sequence
  Description of Artificial Sequence: Synthetic oligonucleotide
  Target: ATXN1; (+) strand; PAM type: YTN; PAM sequence: TTT
aaatttttattttttatatt

SEQ ID NO: 300368 - DNA, 20 bp, Artificial Sequence
  Description of Artificial Sequence: Synthetic oligonucleotide
  Target: ATXN1; (+) strand; PAM type: YTN; PAM sequence: TTA
aatttttattttttatattg

SEQ ID NO: 300369 - DNA, 20 bp, Artificial Sequence
  Description of Artificial Sequence: Synthetic oligonucleotide
  Target: ATXN1; (+) strand; PAM type: YTN; PAM sequence: TTT
ttattttttatattgttgta

SEQ ID NO: 300370 - DNA, 20 bp, Artificial Sequence
  Description of Artificial Sequence: Synthetic oligonucleotide
  Target: ATXN1; (+) strand; PAM type: YTN; PAM sequence: TTT
tattttttatattgttgtaa

SEQ ID NO: 300371 - DNA, 20 bp, Artificial Sequence
  Description of Artificial Sequence: Synthetic oligonucleotide
  Target: ATXN1; (+) strand; PAM type: YTN; PAM sequence: TTT
attttttatattgttgtaag

SEQ ID NO: 300372 - DNA, 20 bp, Artificial Sequence
  Description of Artificial Sequence: Synthetic oligonucleotide
  Target: ATXN1; (+) strand; PAM type: YTN; PAM sequence: TTA
ttttttatattgttgtaagt

SEQ ID NO: 300373 - DNA, 20 bp, Artificial Sequence
  Description of Artificial Sequence: Synthetic oligonucleotide
  Target: ATXN1; (+) strand; PAM type: YTN; PAM sequence: TTT
tttatattgttgtaagtttt

SEQ ID NO: 300374 - DNA, 20 bp, Artificial Sequence
  Description of Artificial Sequence: Synthetic oligonucleotide
  Target: ATXN1; (+) strand; PAM type: YTN; PAM sequence: TTT
ttatattgttgtaagttttt

SEQ ID NO: 300375 - DNA, 20 bp, Artificial Sequence
  Description of Artificial Sequence: Synthetic oligonucleotide
  Target: ATXN1; (+) strand; PAM type: YTN; PAM sequence: TTT
tatattgttgtaagttttta

SEQ ID NO: 300376 - DNA, 20 bp, Artificial Sequence
  Description of Artificial Sequence: Synthetic oligonucleotide
  Target: ATXN1; (+) strand; PAM type: YTN; PAM sequence: TTT
atattgttgtaagtttttac

SEQ ID NO: 300377 - DNA, 20 bp, Artificial Sequence
  Description of Artificial Sequence: Synthetic oligonucleotide
  Target: ATXN1; (+) strand; PAM type: YTN; PAM sequence: TTA
tattgttgtaagtttttact

SEQ ID NO: 300378 - DNA, 20 bp, Artificial Sequence
  Description of Artificial Sequence: Synthetic oligonucleotide
  Target: ATXN1; (+) strand; PAM type: YTN; PAM sequence: TTG
ttgtaagtttttacttttga

SEQ ID NO: 300379 - DNA, 20 bp, Artificial Sequence
  Description of Artificial Sequence: Synthetic oligonucleotide
  Target: ATXN1; (+) strand; PAM type: YTN; PAM sequence: TTG
taagtttttacttttgagac

SEQ ID NO: 300380 - DNA, 20 bp, Artificial Sequence
  Description of Artificial Sequence: Synthetic oligonucleotide
  Target: ATXN1; (+) strand; PAM type: YTN; PAM sequence: TTT
ttacttttgagacagggtat

SEQ ID NO: 300381 - DNA, 20 bp, Artificial Sequence
  Description of Artificial Sequence: Synthetic oligonucleotide
  Target: ATXN1; (+) strand; PAM type: YTN; PAM sequence: TTT
tacttttgagacagggtatc

SEQ ID NO: 300382 - DNA, 20 bp, Artificial Sequence
  Description of Artificial Sequence: Synthetic oligonucleotide
  Target: ATXN1; (+) strand; PAM type: YTN; PAM sequence: TTT
acttttgagacagggtatca

SEQ ID NO: 300383 - DNA, 20 bp, Artificial Sequence
  Description of Artificial Sequence: Synthetic oligonucleotide
  Target: ATXN1; (+) strand; PAM type: YTN; PAM sequence: TTA
cttttgagacagggtatcac

SEQ ID NO: 300384 - DNA, 20 bp, Artificial Sequence
  Description of Artificial Sequence: Synthetic oligonucleotide
  Target: ATXN1; (+) strand; PAM type: YTN; PAM sequence: CTT
ttgagacagggtatcactct

SEQ ID NO: 300385 - DNA, 20 bp, Artificial Sequence
  Description of Artificial Sequence: Synthetic oligonucleotide
  Target: ATXN1; (+) strand; PAM type: YTN; PAM sequence: TTT
tgagacagggtatcactctc

SEQ ID NO: 300386 - DNA, 20 bp, Artificial Sequence
  Description of Artificial Sequence: Synthetic oligonucleotide
  Target: ATXN1; (+) strand; PAM type: YTN; PAM sequence: TTT
gagacagggtatcactctct

SEQ ID NO: 300387 - DNA, 20 bp, Artificial Sequence
  Description of Artificial Sequence: Synthetic oligonucleotide
  Target: ATXN1; (+) strand; PAM type: YTN; PAM sequence: TTG
agacagggtatcactctctt

SEQ ID NO: 300388 - DNA, 20 bp, Artificial Sequence
  Description of Artificial Sequence: Synthetic oligonucleotide
  Target: ATXN1; (+) strand; PAM type: YTN; PAM sequence: CTC
tcttgctcaggctagagcgc

SEQ ID NO: 300389 - DNA, 20 bp, Artificial Sequence
  Description of Artificial Sequence: Synthetic oligonucleotide
  Target: ATXN1; (+) strand; PAM type: YTN; PAM sequence: CTC
ttgctcaggctagagcgcag

SEQ ID NO: 300390 - DNA, 20 bp, Artificial Sequence
  Description of Artificial Sequence: Synthetic oligonucleotide
  Target: ATXN1; (+) strand; PAM type: YTN; PAM sequence: CTT
gctcaggctagagcgcagtg

SEQ ID NO: 300391 - DNA, 20 bp, Artificial Sequence
  Description of Artificial Sequence: Synthetic oligonucleotide
  Target: ATXN1; (+) strand; PAM type: YTN; PAM sequence: TTG
ctcaggctagagcgcagtgg

SEQ ID NO: 300392 - DNA, 20 bp, Artificial Sequence
  Description of Artificial Sequence: Synthetic oligonucleotide
  Target: ATXN1; (+) strand; PAM type: YTN; PAM sequence: CTC
aggctagagcgcagtggcat

SEQ ID NO: 300393 - DNA, 20 bp, Artificial Sequence
  Description of Artificial Sequence: Synthetic oligonucleotide
  Target: ATXN1; (+) strand; PAM type: YTN; PAM sequence: CTA
gagcgcagtggcatgatcat

SEQ ID NO: 300394 - DNA, 20 bp, Artificial Sequence
  Description of Artificial Sequence: Synthetic oligonucleotide
  Target: ATXN1; (+) strand; PAM type: YTN; PAM sequence: CTC
actacagccacaaactcctg

SEQ ID NO: 300395 - DNA, 20 bp, Artificial Sequence
  Description of Artificial Sequence: Synthetic oligonucleotide
  Target: ATXN1; (+) strand; PAM type: YTN; PAM sequence: CTA
cagccacaaactcctgggcc

SEQ ID NO: 300396 - DNA, 20 bp, Artificial Sequence
  Description of Artificial Sequence: Synthetic oligonucleotide
  Target: ATXN1; (+) strand; PAM type: YTN; PAM sequence: CTC
ctgggcccatgggatcctcc

SEQ ID NO: 300397 - DNA, 20 bp, Artificial Sequence
  Description of Artificial Sequence: Synthetic oligonucleotide
  Target: ATXN1; (+) strand; PAM type: YTN; PAM sequence: CTG
ggcccatgggatcctcccac

SEQ ID NO: 300398 - DNA, 20 bp, Artificial Sequence
  Description of Artificial Sequence: Synthetic oligonucleotide
  Target: ATXN1; (+) strand; PAM type: YTN; PAM sequence: CTC
ccacctcagctcccgagcag

SEQ ID NO: 300399 - DNA, 20 bp, Artificial Sequence
  Description of Artificial Sequence: Synthetic oligonucleotide
  Target: ATXN1; (+) strand; PAM type: YTN; PAM sequence: CTC
agctcccgagcagctgagac

SEQ ID NO: 300400 - DNA, 20 bp, Artificial Sequence
  Description of Artificial Sequence: Synthetic oligonucleotide
  Target: ATXN1; (+) strand; PAM type: YTN; PAM sequence: CTC
ccgagcagctgagactacag

SEQ ID NO: 300401 - DNA, 20 bp, Artificial Sequence
  Description of Artificial Sequence: Synthetic oligonucleotide
  Target: ATXN1; (+) strand; PAM type: YTN; PAM sequence: CTG
agactacaggcaagagccac

SEQ ID NO: 300402 - DNA, 20 bp, Artificial Sequence
  Description of Artificial Sequence: Synthetic oligonucleotide
  Target: ATXN1; (+) strand; PAM type: YTN; PAM sequence: CTA
caggcaagagccaccacacc

SEQ ID NO: 300403 - DNA, 20 bp, Artificial Sequence
  Description of Artificial Sequence: Synthetic oligonucleotide
  Target: ATXN1; (+) strand; PAM type: YTN; PAM sequence: TTT
tttcttttttttccttcctt

SEQ ID NO: 300404 - DNA, 20 bp, Artificial Sequence
  Description of Artificial Sequence: Synthetic oligonucleotide
  Target: ATXN1; (+) strand; PAM type: YTN; PAM sequence: TTT
ttcttttttttccttccttt

SEQ ID NO: 300405 - DNA, 20 bp, Artificial Sequence
  Description of Artificial Sequence: Synthetic oligonucleotide
  Target: ATXN1; (+) strand; PAM type: YTN; PAM sequence: TTT
tcttttttttccttcctttt

SEQ ID NO: 300406 - DNA, 20 bp, Artificial Sequence
  Description of Artificial Sequence: Synthetic oligonucleotide
  Target: ATXN1; (+) strand; PAM type: YTN; PAM sequence: TTT
cttttttttccttccttttt

SEQ ID NO: 300407 - DNA, 20 bp, Artificial Sequence
  Description of Artificial Sequence: Synthetic oligonucleotide
  Target: ATXN1; (+) strand; PAM type: YTN; PAM sequence: TTC
ttttttttccttcctttttt

SEQ ID NO: 300408 - DNA, 20 bp, Artificial Sequence
  Description of Artificial Sequence: Synthetic oligonucleotide
  Target: ATXN1; (+) strand; PAM type: YTN; PAM sequence: CTT
ttttttccttcctttttttt

SEQ ID NO: 300409 - DNA, 20 bp, Artificial Sequence
  Description of Artificial Sequence: Synthetic oligonucleotide
  Target: ATXN1; (+) strand; PAM type: YTN; PAM sequence: TTT
tttttccttccttttttttt

SEQ ID NO: 300410 - DNA, 20 bp, Artificial Sequence
  Description of Artificial Sequence: Synthetic oligonucleotide
  Target: ATXN1; (+) strand; PAM type: YTN; PAM sequence: TTT
ttttccttcctttttttttc

SEQ ID NO: 300411 - DNA, 20 bp, Artificial Sequence
  Description of Artificial Sequence: Synthetic oligonucleotide
  Target: ATXN1; (+) strand; PAM type: YTN; PAM sequence: TTT
tttccttcctttttttttct

SEQ ID NO: 300412 - DNA, 20 bp, Artificial Sequence
  Description of Artificial Sequence: Synthetic oligonucleotide
  Target: ATXN1; (+) strand; PAM type: YTN; PAM sequence: TTT
ttccttcctttttttttctt

SEQ ID NO: 300413 - DNA, 20 bp, Artificial Sequence
  Description of Artificial Sequence: Synthetic oligonucleotide
  Target: ATXN1; (+) strand; PAM type: YTN; PAM sequence: TTT
tccttcctttttttttcttt

SEQ ID NO: 300414 - DNA, 20 bp, Artificial Sequence
  Description of Artificial Sequence: Synthetic oligonucleotide
  Target: ATXN1; (+) strand; PAM type: YTN; PAM sequence: TTT
ccttcctttttttttctttt

SEQ ID NO: 300415 - DNA, 20 bp, Artificial Sequence
  Description of Artificial Sequence: Synthetic oligonucleotide
  Target: ATXN1; (+) strand; PAM type: YTN; PAM sequence: TTC
cttcctttttttttcttttt

SEQ ID NO: 300416 - DNA, 20 bp, Artificial Sequence
  Description of Artificial Sequence: Synthetic oligonucleotide
  Target: ATXN1; (+) strand; PAM type: YTN; PAM sequence: CTT
cctttttttttctttttttt

SEQ ID NO: 300417 - DNA, 20 bp, Artificial Sequence
  Description of Artificial Sequence: Synthetic oligonucleotide
  Target: ATXN1; (+) strand; PAM type: YTN; PAM sequence: TTC
ctttttttttcttttttttt

SEQ ID NO: 300418 - DNA, 20 bp, Artificial Sequence
  Description of Artificial Sequence: Synthetic oligonucleotide
  Target: ATXN1; (+) strand; PAM type: YTN; PAM sequence: CTT
tttttttcttttttttttct

SEQ ID NO: 300419 - DNA, 20 bp, Artificial Sequence
  Description of Artificial Sequence: Synthetic oligonucleotide
  Target: ATXN1; (+) strand; PAM type: YTN; PAM sequence: TTT
ttttttcttttttttttctt

SEQ ID NO: 300420 - DNA, 20 bp, Artificial Sequence
  Description of Artificial Sequence: Synthetic oligonucleotide
  Target: ATXN1; (+) strand; PAM type: YTN; PAM sequence: TTT
tttttcttttttttttcttt

SEQ ID NO: 300421 - DNA, 20 bp, Artificial Sequence
  Description of Artificial Sequence: Synthetic oligonucleotide
  Target: ATXN1; (+) strand; PAM type: YTN; PAM sequence: TTT
ttttcttttttttttctttt

SEQ ID NO: 300422 - DNA, 20 bp, Artificial Sequence
  Description of Artificial Sequence: Synthetic oligonucleotide
  Target: ATXN1; (+) strand; PAM type: YTN; PAM sequence: TTT
tttcttttttttttcttttt

SEQ ID NO: 300423 - DNA, 20 bp, Artificial Sequence
  Description of Artificial Sequence: Synthetic oligonucleotide
  Target: ATXN1; (+) strand; PAM type: YTN; PAM sequence: TTT
ttcttttttttttctttttt

SEQ ID NO: 300424 - DNA, 20 bp, Artificial Sequence
  Description of Artificial Sequence: Synthetic oligonucleotide
  Target: ATXN1; (+) strand; PAM type: YTN; PAM sequence: TTT
tcttttttttttcttttttt

SEQ ID NO: 300425 - DNA, 20 bp, Artificial Sequence
  Description of Artificial Sequence: Synthetic oligonucleotide
  Target: ATXN1; (+) strand; PAM type: YTN; PAM sequence: TTT
cttttttttttctttttttt

SEQ ID NO: 300426 - DNA, 20 bp, Artificial Sequence
  Description of Artificial Sequence: Synthetic oligonucleotide
  Target: ATXN1; (+) strand; PAM type: YTN; PAM sequence: TTC
ttttttttttcttttttttt

SEQ ID NO: 300427 - DNA, 20 bp, Artificial Sequence
  Description of Artificial Sequence: Synthetic oligonucleotide
  Target: ATXN1; (+) strand; PAM type: YTN; PAM sequence: CTT
ttttttttcttttttttttt

SEQ ID NO: 300428 - DNA, 20 bp, Artificial Sequence
  Description of Artificial Sequence: Synthetic oligonucleotide
  Target: ATXN1; (+) strand; PAM type: YTN; PAM sequence: TTT
tttttttctttttttttttt

SEQ ID NO: 300429 - DNA, 20 bp, Artificial Sequence
  Description of Artificial Sequence: Synthetic oligonucleotide
  Target: ATXN1; (+) strand; PAM type: YTN; PAM sequence: TTT
ttttttcttttttttttttt

SEQ ID NO: 300430 - DNA, 20 bp, Artificial Sequence
  Description of Artificial Sequence: Synthetic oligonucleotide
  Target: ATXN1; (+) strand; PAM type: YTN; PAM sequence: TTT
tttttctttttttttttttt

SEQ ID NO: 300431 - DNA, 20 bp, Artificial Sequence
  Description of Artificial Sequence: Synthetic oligonucleotide
  Target: ATXN1; (+) strand; PAM type: YTN; PAM sequence: TTT
ttttcttttttttttttttg

SEQ ID NO: 300432 - DNA, 20 bp, Artificial Sequence
  Description of Artificial Sequence: Synthetic oligonucleotide
  Target: ATXN1; (+) strand; PAM type: YTN; PAM sequence: TTT
tttcttttttttttttttgt

SEQ ID NO: 300433 - DNA, 20 bp, Artificial Sequence
  Description of Artificial Sequence: Synthetic oligonucleotide
  Target: ATXN1; (+) strand; PAM type: YTN; PAM sequence: TTT
ttcttttttttttttttgta

SEQ ID NO: 300434 - DNA, 20 bp, Artificial Sequence
  Description of Artificial Sequence: Synthetic oligonucleotide
  Target: ATXN1; (+) strand; PAM type: YTN; PAM sequence: TTT
tcttttttttttttttgtag

SEQ ID NO: 300435 - DNA, 20 bp, Artificial Sequence
  Description of Artificial Sequence: Synthetic oligonucleotide
  Target: ATXN1; (+) strand; PAM type: YTN; PAM sequence: TTT
cttttttttttttttgtaga

SEQ ID NO: 300436 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttttgtagag

SEQ ID NO: 300437 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttgtagagat

SEQ ID NO: 300438 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgtagagatg

SEQ ID NO: 300439 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgtagagatgg

SEQ ID NO: 300440 - DNA, 20 bp, Artificial Sequence
  Description of Artificial Sequence: Synthetic oligonucleotide
  Target: ATXN1; (+) strand; PAM type: YTN; PAM sequence: TTT
tttttttttgtagagatgga

SEQ ID NO: 300441 - DNA, 20 bp, Artificial Sequence
  Description of Artificial Sequence: Synthetic oligonucleotide
  Target: ATXN1; (+) strand; PAM type: YTN; PAM sequence: TTT
ttttttttgtagagatggag

SEQ ID NO: 300442 - DNA, 20 bp, Artificial Sequence
  Description of Artificial Sequence: Synthetic oligonucleotide
  Target: ATXN1; (+) strand; PAM type: YTN; PAM sequence: TTT
tttttttgtagagatggagt

SEQ ID NO: 300443 - DNA, 20 bp, Artificial Sequence
  Description of Artificial Sequence: Synthetic oligonucleotide
  Target: ATXN1; (+) strand; PAM type: YTN; PAM sequence: TTT
ttttttgtagagatggagtc

SEQ ID NO: 300444 - DNA, 20 bp, Artificial Sequence
  Description of Artificial Sequence: Synthetic oligonucleotide
  Target: ATXN1; (+) strand; PAM type: YTN; PAM sequence: TTT
tttttgtagagatggagtct

SEQ ID NO: 300445 - DNA, 20 bp, Artificial Sequence
  Description of Artificial Sequence: Synthetic oligonucleotide
  Target: ATXN1; (+) strand; PAM type: YTN; PAM sequence: TTT
ttttgtagagatggagtctc

SEQ ID NO: 300446 - DNA, 20 bp, Artificial Sequence
  Description of Artificial Sequence: Synthetic oligonucleotide
  Target: ATXN1; (+) strand; PAM type: YTN; PAM sequence: TTT
tttgtagagatggagtctcc

SEQ ID NO: 300447 - DNA, 20 bp, Artificial Sequence
  Description of Artificial Sequence: Synthetic oligonucleotide
  Target: ATXN1; (+) strand; PAM type: YTN; PAM sequence: TTT
ttgtagagatggagtctccc

SEQ ID NO: 300448 - DNA, 20 bp, Artificial Sequence
  Description of Artificial Sequence: Synthetic oligonucleotide
  Target: ATXN1; (+) strand; PAM type: YTN; PAM sequence: TTT
tgtagagatggagtctccct

SEQ ID NO: 300449 - DNA, 20 bp, Artificial Sequence
  Description of Artificial Sequence: Synthetic oligonucleotide
  Target: ATXN1; (+) strand; PAM type: YTN; PAM sequence: TTT
gtagagatggagtctcccta

SEQ ID NO: 300450 - DNA, 20 bp, Artificial Sequence
  Description of Artificial Sequence: Synthetic oligonucleotide
  Target: ATXN1; (+) strand; PAM type: YTN; PAM sequence: TTG
tagagatggagtctccctat

SEQ ID NO: 300451 - DNA, 20 bp, Artificial Sequence
  Description of Artificial Sequence: Synthetic oligonucleotide
  Target: ATXN1; (+) strand; PAM type: YTN; PAM sequence: CTC
cctatgttgcccaagctgct

SEQ ID NO: 300452 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaagctgctgtca

SEQ ID NO: 300453 - DNA, 20 bp, Artificial Sequence
  Description of Artificial Sequence: Synthetic oligonucleotide
  Target: ATXN1; (+) strand; PAM type: YTN; PAM sequence: TTG
cccaagctgctgtcaaactc

SEQ ID NO: 300454 - DNA, 20 bp, Artificial Sequence
  Description of Artificial Sequence: Synthetic oligonucleotide
  Target: ATXN1; (+) strand; PAM type: YTN; PAM sequence: CTG
ctgtcaaactcctgggctca

SEQ ID NO: 300455 - DNA, 20 bp, Artificial Sequence
  Description of Artificial Sequence: Synthetic oligonucleotide
  Target: ATXN1; (+) strand; PAM type: YTN; PAM sequence: CTG
tcaaactcctgggctcaagg

SEQ ID NO: 300456 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagggatcctcc

SEQ ID NO: 300457 - DNA, 20 bp, Artificial Sequence
  Description of Artificial Sequence: Synthetic oligonucleotide
  Target: ATXN1; (+) strand; PAM type: YTN; PAM sequence: CTG
ggctcaagggatcctcccac

SEQ ID NO: 300458 - DNA, 20 bp, Artificial Sequence
  Description of Artificial Sequence: Synthetic oligonucleotide
  Target: ATXN1; (+) strand; PAM type: YTN; PAM sequence: CTC
aagggatcctcccaccttgg

SEQ ID NO: 300459 - DNA, 20 bp, Artificial Sequence
  Description of Artificial Sequence: Synthetic oligonucleotide
  Target: ATXN1; (+) strand; PAM type: YTN; PAM sequence: CTC
ccaccttggcctagatttgt

SEQ ID NO: 300460 - DNA, 20 bp, Artificial Sequence
  Description of Artificial Sequence: Synthetic oligonucleotide
  Target: ATXN1; (+) strand; PAM type: YTN; PAM sequence: CTT
ggcctagatttgtattttta

SEQ ID NO: 300461 - DNA, 20 bp, Artificial Sequence
  Description of Artificial Sequence: Synthetic oligonucleotide
  Target: ATXN1; (+) strand; PAM type: YTN; PAM sequence: TTG
gcctagatttgtatttttaa

SEQ ID NO: 300462 - DNA, 20 bp, Artificial Sequence
  Description of Artificial Sequence: Synthetic oligonucleotide
  Target: ATXN1; (+) strand; PAM type: YTN; PAM sequence: CTA
gatttgtatttttaattgac

SEQ ID NO: 300463 - DNA, 20 bp, Artificial Sequence
  Description of Artificial Sequence: Synthetic oligonucleotide
  Target: ATXN1; (+) strand; PAM type: YTN; PAM sequence: TTT
gtatttttaattgacaaata

SEQ ID NO: 300464 - DNA, 20 bp, Artificial Sequence
  Description of Artificial Sequence: Synthetic oligonucleotide
  Target: ATXN1; (+) strand; PAM type: YTN; PAM sequence: TTG
tatttttaattgacaaataa

SEQ ID NO: 300465 - DNA, 20 bp, Artificial Sequence
  Description of Artificial Sequence: Synthetic oligonucleotide
  Target: ATXN1; (+) strand; PAM type: YTN; PAM sequence: TTT
ttaattgacaaataataatt

SEQ ID NO: 300466 - DNA, 20 bp, Artificial Sequence
  Description of Artificial Sequence: Synthetic oligonucleotide
  Target: ATXN1; (+) strand; PAM type: YTN; PAM sequence: TTT
taattgacaaataataattg

SEQ ID NO: 300467 - DNA, 20 bp, Artificial Sequence
  Description of Artificial Sequence: Synthetic oligonucleotide
  Target: ATXN1; (+) strand; PAM type: YTN; PAM sequence: TTT
aattgacaaataataattgc

SEQ ID NO: 300468 - DNA, 20 bp, Artificial Sequence
  Description of Artificial Sequence: Synthetic oligonucleotide
  Target: ATXN1; (+) strand; PAM type: YTN; PAM sequence: TTA
attgacaaataataattgca

SEQ ID NO: 300469 - DNA, 20 bp, Artificial Sequence
  Description of Artificial Sequence: Synthetic oligonucleotide
  Target: ATXN1; (+) strand; PAM type: YTN; PAM sequence: TTG
acaaataataattgcatgta

SEQ ID NO: 300470 - DNA, 20 bp, Artificial Sequence
  Description of Artificial Sequence: Synthetic oligonucleotide
  Target: ATXN1; (+) strand; PAM type: YTN; PAM sequence: TTG
catgtagttatgggttataa

SEQ ID NO: 300471 - DNA, 20 bp, Artificial Sequence
  Description of Artificial Sequence: Synthetic oligonucleotide
  Target: ATXN1; (+) strand; PAM type: YTN; PAM sequence: TTA
tgggttataatgtgatgttt

SEQ ID NO: 300472 - DNA, 20 bp, Artificial Sequence
  Description of Artificial Sequence: Synthetic oligonucleotide
  Target: ATXN1; (+) strand; PAM type: YTN; PAM sequence: TTA
taatgtgatgttttgatata

SEQ ID NO: 300473 - DNA, 20 bp, Artificial Sequence
  Description of Artificial Sequence: Synthetic oligonucleotide
  Target: ATXN1; (+) strand; PAM type: YTN; PAM sequence: TTT
tgatatagctacatatacta

SEQ ID NO: 300474 - DNA, 20 bp, Artificial Sequence
  Description of Artificial Sequence: Synthetic oligonucleotide
  Target: ATXN1; (+) strand; PAM type: YTN; PAM sequence: TTT
gatatagctacatatactat

SEQ ID NO: 300475 - DNA, 20 bp, Artificial Sequence
  Description of Artificial Sequence: Synthetic oligonucleotide
  Target: ATXN1; (+) strand; PAM type: YTN; PAM sequence: TTG
atatagctacatatactata

SEQ ID NO: 300476 - DNA, 20 bp, Artificial Sequence
  Description of Artificial Sequence: Synthetic oligonucleotide
  Target: ATXN1; (+) strand; PAM type: YTN; PAM sequence: CTA
catatactataaaatgatta

SEQ ID NO: 300477 - DNA, 20 bp, Artificial Sequence
  Description of Artificial Sequence: Synthetic oligonucleotide
  Target: ATXN1; (+) strand; PAM type: YTN; PAM sequence: CTA
taaaatgattatattaagct

SEQ ID NO: 300478 - DNA, 20 bp, Artificial Sequence
  Description of Artificial Sequence: Synthetic oligonucleotide
  Target: ATXN1; (+) strand; PAM type: YTN; PAM sequence: TTA
tattaagctgattaatatgt

SEQ ID NO: 300479 - DNA, 20 bp, Artificial Sequence
  Description of Artificial Sequence: Synthetic oligonucleotide
  Target: ATXN1; (+) strand; PAM type: YTN; PAM sequence: TTA
agctgattaatatgtccatc

SEQ ID NO: 300480 - DNA, 20 bp, Artificial Sequence
  Description of Artificial Sequence: Synthetic oligonucleotide
  Target: ATXN1; (+) strand; PAM type: YTN; PAM sequence: CTG
attaatatgtccatcacctc

SEQ ID NO: 300481 - DNA, 20 bp, Artificial Sequence
  Description of Artificial Sequence: Synthetic oligonucleotide
  Target: ATXN1; (+) strand; PAM type: YTN; PAM sequence: TTA
atatgtccatcacctcacat

SEQ ID NO: 300482 - DNA, 20 bp, Artificial Sequence
  Description of Artificial Sequence: Synthetic oligonucleotide
  Target: ATXN1; (+) strand; PAM type: YTN; PAM sequence: CTC
acatacttattttttataat

SEQ ID NO: 300483 - DNA, 20 bp, Artificial Sequence
  Description of Artificial Sequence: Synthetic oligonucleotide
  Target: ATXN1; (+) strand; PAM type: YTN; PAM sequence: CTT
attttttataatgaagacat

SEQ ID NO: 300484 - DNA, 20 bp, Artificial Sequence
  Description of Artificial Sequence: Synthetic oligonucleotide
  Target: ATXN1; (+) strand; PAM type: YTN; PAM sequence: TTA
ttttttataatgaagacatt

SEQ ID NO: 300485 - DNA, 20 bp, Artificial Sequence
  Description of Artificial Sequence: Synthetic oligonucleotide
  Target: ATXN1; (+) strand; PAM type: YTN; PAM sequence: TTT
tttataatgaagacatttaa

SEQ ID NO: 300486 - DNA, 20 bp, Artificial Sequence
  Description of Artificial Sequence: Synthetic oligonucleotide
  Target: ATXN1; (+) strand; PAM type: YTN; PAM sequence: TTT
ttataatgaagacatttaaa

SEQ ID NO: 300487 - DNA, 20 bp, Artificial Sequence
  Description of Artificial Sequence: Synthetic oligonucleotide
  Target: ATXN1; (+) strand; PAM type: YTN; PAM sequence: TTT
tataatgaagacatttaaaa

SEQ ID NO: 300488 - DNA, 20 bp, Artificial Sequence
  Description of Artificial Sequence: Synthetic oligonucleotide
  Target: ATXN1; (+) strand; PAM type: YTN; PAM sequence: TTT
ataatgaagacatttaaaaa

SEQ ID NO: 300489 - DNA, 20 bp, Artificial Sequence
  Description of Artificial Sequence: Synthetic oligonucleotide
  Target: ATXN1; (+) strand; PAM type: YTN; PAM sequence: TTA
taatgaagacatttaaaaac

SEQ ID NO: 300490 - DNA, 20 bp, Artificial Sequence
  Description of Artificial Sequence: Synthetic oligonucleotide
  Target: ATXN1; (+) strand; PAM type: YTN; PAM sequence: TTT
aaaaacgtattcttttagca

SEQ ID NO: 300491 - DNA, 20 bp, Artificial Sequence
  Description of Artificial Sequence: Synthetic oligonucleotide
  Target: ATXN1; (+) strand; PAM type: YTN; PAM sequence: TTA
aaaacgtattcttttagcaa

SEQ ID NO: 300492 - DNA, 20 bp, Artificial Sequence
  Description of Artificial Sequence: Synthetic oligonucleotide
  Target: ATXN1; (+) strand; PAM type: YTN; PAM sequence: TTC
ttttagcaatcttgacattt

SEQ ID NO: 300493 - DNA, 20 bp, Artificial Sequence
  Description of Artificial Sequence: Synthetic oligonucleotide
  Target: ATXN1; (+) strand; PAM type: YTN; PAM sequence: CTT
ttagcaatcttgacatttat

SEQ ID NO: 300494 - DNA, 20 bp, Artificial Sequence
  Description of Artificial Sequence: Synthetic oligonucleotide
  Target: ATXN1; (+) strand; PAM type: YTN; PAM sequence: TTT
tagcaatcttgacatttata

SEQ ID NO: 300495 - DNA, 20 bp, Artificial Sequence
  Description of Artificial Sequence: Synthetic oligonucleotide
  Target: ATXN1; (+) strand; PAM type: YTN; PAM sequence: TTT
agcaatcttgacatttataa

SEQ ID NO: 300496 - DNA, 20 bp, Artificial Sequence
  Description of Artificial Sequence: Synthetic oligonucleotide
  Target: ATXN1; (+) strand; PAM type: YTN; PAM sequence: TTA
gcaatcttgacatttataat

SEQ ID NO: 300497 - DNA, 20 bp, Artificial Sequence
  Description of Artificial Sequence: Synthetic oligonucleotide
  Target: ATXN1; (+) strand; PAM type: YTN; PAM sequence: CTT
gacatttataataccttatt

SEQ ID NO: 300498 - DNA, 20 bp, Artificial Sequence
  Description of Artificial Sequence: Synthetic oligonucleotide
  Target: ATXN1; (+) strand; PAM type: YTN; PAM sequence: TTG
acatttataataccttatta

SEQ ID NO: 300499 - DNA, 20 bp, Artificial Sequence
  Description of Artificial Sequence: Synthetic oligonucleotide
  Target: ATXN1; (+) strand; PAM type: YTN; PAM sequence: TTT
ataataccttattatgaggg

SEQ ID NO: 300500 - DNA, 20 bp, Artificial Sequence
  Description of Artificial Sequence: Synthetic oligonucleotide
  Target: ATXN1; (+) strand; PAM type: YTN; PAM sequence: TTA
taataccttattatgagggc

SEQ ID NO: 300501 - DNA, 20 bp, Artificial Sequence
  Description of Artificial Sequence: Synthetic oligonucleotide
  Target: ATXN1; (+) strand; PAM type: YTN; PAM sequence: CTT
attatgagggctaaaaatga

SEQ ID NO: 300502 - DNA, 20 bp, Artificial Sequence
  Description of Artificial Sequence: Synthetic oligonucleotide
  Target: ATXN1; (+) strand; PAM type: YTN; PAM sequence: TTA
ttatgagggctaaaaatgaa

SEQ ID NO: 300503 - DNA, 20 bp, Artificial Sequence
  Description of Artificial Sequence: Synthetic oligonucleotide
  Target: ATXN1; (+) strand; PAM type: YTN; PAM sequence: TTA
tgagggctaaaaatgaataa

SEQ ID NO: 300504 - DNA, 20 bp, Artificial Sequence
  Description of Artificial Sequence: Synthetic oligonucleotide
  Target: ATXN1; (+) strand; PAM type: YTN; PAM sequence: CTA
aaaatgaataatattaataa

SEQ ID NO: 300505 - DNA, 20 bp, Artificial Sequence
  Description of Artificial Sequence: Synthetic oligonucleotide
  Target: ATXN1; (+) strand; PAM type: YTN; PAM sequence: TTA
ataatcctgtacaatgggtc

SEQ ID NO: 300506 - DNA, 20 bp, Artificial Sequence
  Description of Artificial Sequence: Synthetic oligonucleotide
  Target: ATXN1; (+) strand; PAM type: YTN; PAM sequence: CTG
tacaatgggtctcagaaact

SEQ ID NO: 300507 - DNA, 20 bp, Artificial Sequence
  Description of Artificial Sequence: Synthetic oligonucleotide
  Target: ATXN1; (+) strand; PAM type: YTN; PAM sequence: CTC
agaaacttagccctcttgtc

SEQ ID NO: 300508 - DNA, 20 bp, Artificial Sequence
  Description of Artificial Sequence: Synthetic oligonucleotide
  Target: ATXN1; (+) strand; PAM type: YTN; PAM sequence: CTT
agccctcttgtctaactgaa

SEQ ID NO: 300509 - DNA, 20 bp, Artificial Sequence
  Description of Artificial Sequence: Synthetic oligonucleotide
  Target: ATXN1; (+) strand; PAM type: YTN; PAM sequence: TTA
gccctcttgtctaactgaaa

SEQ ID NO: 300510 - DNA, 20 bp, Artificial Sequence
  Description of Artificial Sequence: Synthetic oligonucleotide
  Target: ATXN1; (+) strand; PAM type: YTN; PAM sequence: CTC
ttgtctaactgaaacgtctg

SEQ ID NO: 300511 - DNA, 20 bp, Artificial Sequence
  Description of Artificial Sequence: Synthetic oligonucleotide
  Target: ATXN1; (+) strand; PAM type: YTN; PAM sequence: CTT
gtctaactgaaacgtctgta

SEQ ID NO: 300512 - DNA, 20 bp, Artificial Sequence
  Description of Artificial Sequence: Synthetic oligonucleotide
  Target: ATXN1; (+) strand; PAM type: YTN; PAM sequence: TTG
tctaactgaaacgtctgtac

SEQ ID NO: 300513 - DNA, 20 bp, Artificial Sequence
  Description of Artificial Sequence: Synthetic oligonucleotide
  Target: ATXN1; (+) strand; PAM type: YTN; PAM sequence: CTA
actgaaacgtctgtaccgtt

SEQ ID NO: 300514 - DNA, 20 bp, Artificial Sequence
  Description of Artificial Sequence: Synthetic oligonucleotide
  Target: ATXN1; (+) strand; PAM type: YTN; PAM sequence: CTG
aaacgtctgtaccgtttgat

SEQ ID NO: 300515 - DNA, 20 bp, Artificial Sequence
  Description of Artificial Sequence: Synthetic oligonucleotide
  Target: ATXN1; (+) strand; PAM type: YTN; PAM sequence: CTG
taccgtttgatcaaccaaag

SEQ ID NO: 300516 - DNA, 20 bp, Artificial Sequence
  Description of Artificial Sequence: Synthetic oligonucleotide
  Target: ATXN1; (+) strand; PAM type: YTN; PAM sequence: TTT
gatcaaccaaagatggcttt

SEQ ID NO: 300517 - DNA, 20 bp, Artificial Sequence
  Description of Artificial Sequence: Synthetic oligonucleotide
  Target: ATXN1; (+) strand; PAM type: YTN; PAM sequence: TTG
atcaaccaaagatggctttt

SEQ ID NO: 300518 - DNA, 20 bp, Artificial Sequence
  Description of Artificial Sequence: Synthetic oligonucleotide
  Target: ATXN1; (+) strand; PAM type: YTN; PAM sequence: CTT
ttgttggcaattcaattttt

SEQ ID NO: 300519 - DNA, 20 bp, Artificial Sequence
  Description of Artificial Sequence: Synthetic oligonucleotide
  Target: ATXN1; (+) strand; PAM type: YTN; PAM sequence: TTT
tgttggcaattcaatttttt

SEQ ID NO: 300520 - DNA, 20 bp, Artificial Sequence
  Description of Artificial Sequence: Synthetic oligonucleotide
  Target: ATXN1; (+) strand; PAM type: YTN; PAM sequence: TTT
gttggcaattcaattttttt

SEQ ID NO: 300521 - DNA, 20 bp, Artificial Sequence
  Description of Artificial Sequence: Synthetic oligonucleotide
  Target: ATXN1; (+) strand; PAM type: YTN; PAM sequence: TTG
ttggcaattcaatttttttg

SEQ ID NO: 300522 - DNA, 20 bp, Artificial Sequence
  Description of Artificial Sequence: Synthetic oligonucleotide
  Target: ATXN1; (+) strand; PAM type: YTN; PAM sequence: TTG
gcaattcaatttttttgaca

SEQ ID NO: 300523 - DNA, 20 bp, Artificial Sequence
  Description of Artificial Sequence: Synthetic oligonucleotide
  Target: ATXN1; (+) strand; PAM type: YTN; PAM sequence: TTC
aatttttttgacaaattcct

SEQ ID NO: 300524 - DNA, 20 bp, Artificial Sequence
  Description of Artificial Sequence: Synthetic oligonucleotide
  Target: ATXN1; (+) strand; PAM type: YTN; PAM sequence: TTT
ttttgacaaattcctcattt

SEQ ID NO: 300525 - DNA, 20 bp, Artificial Sequence
  Description of Artificial Sequence: Synthetic oligonucleotide
  Target: ATXN1; (+) strand; PAM type: YTN; PAM sequence: TTT
tttgacaaattcctcatttt

SEQ ID NO: 300526 - DNA, 20 bp, Artificial Sequence
  Description of Artificial Sequence: Synthetic oligonucleotide
  Target: ATXN1; (+) strand; PAM type: YTN; PAM sequence: TTT
ttgacaaattcctcattttt

SEQ ID NO: 300527 - DNA, 20 bp, Artificial Sequence
  Description of Artificial Sequence: Synthetic oligonucleotide
  Target: ATXN1; (+) strand; PAM type: YTN; PAM sequence: TTT
tgacaaattcctcatttttg

SEQ ID NO: 300528 - DNA, 20 bp, Artificial Sequence
  Description of Artificial Sequence: Synthetic oligonucleotide
  Target: ATXN1; (+) strand; PAM type: YTN; PAM sequence: TTT
gacaaattcctcatttttgt

SEQ ID NO: 300529 - DNA, 20 bp, Artificial Sequence
  Description of Artificial Sequence: Synthetic oligonucleotide
  Target: ATXN1; (+) strand; PAM type: YTN; PAM sequence: TTG
acaaattcctcatttttgtc

SEQ ID NO: 300530 - DNA, 20 bp, Artificial Sequence
  Description of Artificial Sequence: Synthetic oligonucleotide
  Target: ATXN1; (+) strand; PAM type: YTN; PAM sequence: TTC
ctcatttttgtcttcatttg

SEQ ID NO: 300531 - DNA, 20 bp, Artificial Sequence
  Description of Artificial Sequence: Synthetic oligonucleotide
  Target: ATXN1; (+) strand; PAM type: YTN; PAM sequence: CTC
atttttgtcttcatttggag

SEQ ID NO: 300532 - DNA, 20 bp, Artificial Sequence
  Description of Artificial Sequence: Synthetic oligonucleotide
  Target: ATXN1; (+) strand; PAM type: YTN; PAM sequence: TTT
ttgtcttcatttggagtttt

SEQ ID NO: 300533 - DNA, 20 bp, Artificial Sequence
  Description of Artificial Sequence: Synthetic oligonucleotide
  Target: ATXN1; (+) strand; PAM type: YTN; PAM sequence: TTT
tgtcttcatttggagttttt

SEQ ID NO: 300534 - DNA, 20 bp, Artificial Sequence
  Description of Artificial Sequence: Synthetic oligonucleotide
  Target: ATXN1; (+) strand; PAM type: YTN; PAM sequence: TTT
gtcttcatttggagttttta

SEQ ID NO: 300535 - DNA, 20 bp, Artificial Sequence
  Description of Artificial Sequence: Synthetic oligonucleotide
  Target: ATXN1; (+) strand; PAM type: YTN; PAM sequence: TTG
tcttcatttggagtttttat

SEQ ID NO: 300536 - DNA, 20 bp, Artificial Sequence
  Description of Artificial Sequence: Synthetic oligonucleotide
  Target: ATXN1; (+) strand; PAM type: YTN; PAM sequence: CTT
catttggagtttttatccat

SEQ ID NO: 300537 - DNA, 20 bp, Artificial Sequence
  Description of Artificial Sequence: Synthetic oligonucleotide
  Target: ATXN1; (+) strand; PAM type: YTN; PAM sequence: TTC
atttggagtttttatccatt

SEQ ID NO: 300538 - DNA, 20 bp, Artificial Sequence
  Description of Artificial Sequence: Synthetic oligonucleotide
  Target: ATXN1; (+) strand; PAM type: YTN; PAM sequence: TTT
ggagtttttatccattacaa

SEQ ID NO: 300539 - DNA, 20 bp, Artificial Sequence
  Description of Artificial Sequence: Synthetic oligonucleotide
  Target: ATXN1; (+) strand; PAM type: YTN; PAM sequence: TTG
gagtttttatccattacaag

SEQ ID NO: 300540 - DNA, 20 bp, Artificial Sequence
  Description of Artificial Sequence: Synthetic oligonucleotide
  Target: ATXN1; (+) strand; PAM type: YTN; PAM sequence: TTT
ttatccattacaagagagga

SEQ ID NO: 300541 - DNA, 20 bp, Artificial Sequence
  Description of Artificial Sequence: Synthetic oligonucleotide
  Target: ATXN1; (+) strand; PAM type: YTN; PAM sequence: TTT
tatccattacaagagaggaa

SEQ ID NO: 300542 - DNA, 20 bp, Artificial Sequence
  Description of Artificial Sequence: Synthetic oligonucleotide
  Target: ATXN1; (+) strand; PAM type: YTN; PAM sequence: TTT
atccattacaagagaggaag

SEQ ID NO: 300543 - DNA, 20 bp, Artificial Sequence
  Description of Artificial Sequence: Synthetic oligonucleotide
  Target: ATXN1; (+) strand; PAM type: YTN; PAM sequence: TTA
tccattacaagagaggaaga

SEQ ID NO: 300544 - DNA, 20 bp, Artificial Sequence
  Description of Artificial Sequence: Synthetic oligonucleotide
  Target: ATXN1; (+) strand; PAM type: YTN; PAM sequence: TTA
caagagaggaagatgacaca

SEQ ID NO: 300545 - DNA, 20 bp, Artificial Sequence
  Description of Artificial Sequence: Synthetic oligonucleotide
  Target: ATXN1; (+) strand; PAM type: YTN; PAM sequence: CTC
aggattctgaagggaacact

SEQ ID NO: 300546 - DNA, 20 bp, Artificial Sequence
  Description of Artificial Sequence: Synthetic oligonucleotide
  Target: ATXN1; (+) strand; PAM type: YTN; PAM sequence: TTC
tgaagggaacactgggttgg

SEQ ID NO: 300547 - DNA, 20 bp, Artificial Sequence
  Description of Artificial Sequence: Synthetic oligonucleotide
  Target: ATXN1; (+) strand; PAM type: YTN; PAM sequence: CTG
aagggaacactgggttgggt

SEQ ID NO: 300548 - DNA, 20 bp, Artificial Sequence
  Description of Artificial Sequence: Synthetic oligonucleotide
  Target: ATXN1; (+) strand; PAM type: YTN; PAM sequence: CTG
ggttgggttttttttaattt

SEQ ID NO: 300549 - DNA, 20 bp, Artificial Sequence
  Description of Artificial Sequence: Synthetic oligonucleotide
  Target: ATXN1; (+) strand; PAM type: YTN; PAM sequence: TTG
ggttttttttaattttaatt

SEQ ID NO: 300550 - DNA, 20 bp, Artificial Sequence
  Description of Artificial Sequence: Synthetic oligonucleotide
  Target: ATXN1; (+) strand; PAM type: YTN; PAM sequence: TTT
tttttaattttaattttgat

SEQ ID NO: 300551 - DNA, 20 bp, Artificial Sequence
  Description of Artificial Sequence: Synthetic oligonucleotide
  Target: ATXN1; (+) strand; PAM type: YTN; PAM sequence: TTT
ttttaattttaattttgatg

SEQ ID NO: 300552 - DNA, 20 bp, Artificial Sequence
  Description of Artificial Sequence: Synthetic oligonucleotide
  Target: ATXN1; (+) strand; PAM type: YTN; PAM sequence: TTT
tttaattttaattttgatgt

SEQ ID NO: 300553 - DNA, 20 bp, Artificial Sequence
  Description of Artificial Sequence: Synthetic oligonucleotide
  Target: ATXN1; (+) strand; PAM type: YTN; PAM sequence: TTT
ttaattttaattttgatgtt

SEQ ID NO: 300554 - DNA, 20 bp, Artificial Sequence
  Description of Artificial Sequence: Synthetic oligonucleotide
  Target: ATXN1; (+) strand; PAM type: YTN; PAM sequence: TTT
taattttaattttgatgttt

SEQ ID NO: 300555 - DNA, 20 bp, Artificial Sequence
  Description of Artificial Sequence: Synthetic oligonucleotide
  Target: ATXN1; (+) strand; PAM type: YTN; PAM sequence: TTT
aattttaattttgatgttta

SEQ ID NO: 300556 - DNA, 20 bp, Artificial Sequence
  Description of Artificial Sequence: Synthetic oligonucleotide
  Target: ATXN1; (+) strand; PAM type: YTN; PAM sequence: TTA
attttaattttgatgtttat

SEQ ID NO: 300557 - DNA, 20 bp, Artificial Sequence
  Description of Artificial Sequence: Synthetic oligonucleotide
  Target: ATXN1; (+) strand; PAM type: YTN; PAM sequence: TTT
taattttgatgtttattatt

SEQ ID NO: 300558 - DNA, 20 bp, Artificial Sequence
  Description of Artificial Sequence: Synthetic oligonucleotide
  Target: ATXN1; (+) strand; PAM type: YTN; PAM sequence: TTT
aattttgatgtttattattt

SEQ ID NO: 300559 - DNA, 20 bp, Artificial Sequence
  Description of Artificial Sequence: Synthetic oligonucleotide
  Target: ATXN1; (+) strand; PAM type: YTN; PAM sequence: TTA
attttgatgtttattatttg

SEQ ID NO: 300560 - DNA, 20 bp, Artificial Sequence
  Description of Artificial Sequence: Synthetic oligonucleotide
  Target: ATXN1; (+) strand; PAM type: YTN; PAM sequence: TTT
tgatgtttattatttgtctt

SEQ ID NO: 300561 - DNA, 20 bp, Artificial Sequence
  Description of Artificial Sequence: Synthetic oligonucleotide
  Target: ATXN1; (+) strand; PAM type: YTN; PAM sequence: TTT
gatgtttattatttgtctta

SEQ ID NO: 300562 - DNA, 20 bp, Artificial Sequence
  Description of Artificial Sequence: Synthetic oligonucleotide
  Target: ATXN1; (+) strand; PAM type: YTN; PAM sequence: TTG
atgtttattatttgtcttag

SEQ ID NO: 300563 - DNA, 20 bp, Artificial Sequence
  Description of Artificial Sequence: Synthetic oligonucleotide
  Target: ATXN1; (+) strand; PAM type: YTN; PAM sequence: TTT
attatttgtcttagagacgg

SEQ ID NO: 300564 - DNA, 20 bp, Artificial Sequence
  Description of Artificial Sequence: Synthetic oligonucleotide
  Target: ATXN1; (+) strand; PAM type: YTN; PAM sequence: TTA
ttatttgtcttagagacggg

SEQ ID NO: 300565 - DNA, 20 bp, Artificial Sequence
  Description of Artificial Sequence: Synthetic oligonucleotide
  Target: ATXN1; (+) strand; PAM type: YTN; PAM sequence: TTA
tttgtcttagagacggggtc

SEQ ID NO: 300566 - DNA, 20 bp, Artificial Sequence
  Description of Artificial Sequence: Synthetic oligonucleotide
  Target: ATXN1; (+) strand; PAM type: YTN; PAM sequence: TTT
gtcttagagacggggtctca

SEQ ID NO: 300567 - DNA, 20 bp, Artificial Sequence
  Description of Artificial Sequence: Synthetic oligonucleotide
  Target: ATXN1; (+) strand; PAM type: YTN; PAM sequence: TTG
tcttagagacggggtctcac

SEQ ID NO: 300568 - DNA, 20 bp, Artificial Sequence
  Description of Artificial Sequence: Synthetic oligonucleotide
  Target: ATXN1; (+) strand; PAM type: YTN; PAM sequence: CTT
agagacggggtctcactatg

SEQ ID NO: 300569 - DNA, 20 bp, Artificial Sequence
  Description of Artificial Sequence: Synthetic oligonucleotide
  Target: ATXN1; (+) strand; PAM type: YTN; PAM sequence: TTA
gagacggggtctcactatgt

SEQ ID NO: 300570 - DNA, 20 bp, Artificial Sequence
  Description of Artificial Sequence: Synthetic oligonucleotide
  Target: ATXN1; (+) strand; PAM type: YTN; PAM sequence: CTC
actatgttgcccaagttggc

SEQ ID NO: 300571 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaagttggccttg

SEQ ID NO: 300572 - DNA, 20 bp, Artificial Sequence
  Description of Artificial Sequence: Synthetic oligonucleotide
  Target: ATXN1; (+) strand; PAM type: YTN; PAM sequence: TTG
cccaagttggccttgaactc

SEQ ID NO: 300573 - DNA, 20 bp, Artificial Sequence
  Description of Artificial Sequence: Synthetic oligonucleotide
  Target: ATXN1; (+) strand; PAM type: YTN; PAM sequence: TTG
gccttgaactcctctgctca

SEQ ID NO: 300574 - DNA, 20 bp, Artificial Sequence
  Description of Artificial Sequence: Synthetic oligonucleotide
  Target: ATXN1; (+) strand; PAM type: YTN; PAM sequence: CTT
gaactcctctgctcaagtga

SEQ ID NO: 300575 - DNA, 20 bp, Artificial Sequence
  Description of Artificial Sequence: Synthetic oligonucleotide
  Target: ATXN1; (+) strand; PAM type: YTN; PAM sequence: TTG
aactcctctgctcaagtgac

SEQ ID NO: 300576 - DNA, 20 bp, Artificial Sequence
  Description of Artificial Sequence: Synthetic oligonucleotide
  Target: ATXN1; (+) strand; PAM type: YTN; PAM sequence: CTC
ctctgctcaagtgacccttt

SEQ ID NO: 300577 - DNA, 20 bp, Artificial Sequence
  Description of Artificial Sequence: Synthetic oligonucleotide
  Target: ATXN1; (+) strand; PAM type: YTN; PAM sequence: CTC
tgctcaagtgaccctttggc

SEQ ID NO: 300578 - DNA, 20 bp, Artificial Sequence
  Description of Artificial Sequence: Synthetic oligonucleotide
  Target: ATXN1; (+) strand; PAM type: YTN; PAM sequence: CTG
ctcaagtgaccctttggctg

SEQ ID NO: 300579 - DNA, 20 bp, Artificial Sequence
  Description of Artificial Sequence: Synthetic oligonucleotide
  Target: ATXN1; (+) strand; PAM type: YTN; PAM sequence: CTC
aagtgaccctttggctggga

SEQ ID NO: 300580 - DNA, 20 bp, Artificial Sequence
  Description of Artificial Sequence: Synthetic oligonucleotide
  Target: ATXN1; (+) strand; PAM type: YTN; PAM sequence: CTT
tggctgggactgcatgagca

SEQ ID NO: 300581 - DNA, 20 bp, Artificial Sequence
  Description of Artificial Sequence: Synthetic oligonucleotide
  Target: ATXN1; (+) strand; PAM type: YTN; PAM sequence: TTT
ggctgggactgcatgagcac

SEQ ID NO: 300582 - DNA, 20 bp, Artificial Sequence
  Description of Artificial Sequence: Synthetic oligonucleotide
  Target: ATXN1; (+) strand; PAM type: YTN; PAM sequence: TTG
gctgggactgcatgagcaca

SEQ ID NO: 300583 - DNA, 20 bp, Artificial Sequence
  Description of Artificial Sequence: Synthetic oligonucleotide
  Target: ATXN1; (+) strand; PAM type: YTN; PAM sequence: CTG
ggactgcatgagcacaccac

SEQ ID NO: 300584 - DNA, 20 bp, Artificial Sequence
  Description of Artificial Sequence: Synthetic oligonucleotide
  Target: ATXN1; (+) strand; PAM type: YTN; PAM sequence: CTG
catgagcacaccactgcatc

SEQ ID NO: 300585 - DNA, 20 bp, Artificial Sequence
  Description of Artificial Sequence: Synthetic oligonucleotide
  Target: ATXN1; (+) strand; PAM type: YTN; PAM sequence: CTG
catcaggctcatccagttga

SEQ ID NO: 300586 - DNA, 20 bp, Artificial Sequence
  Description of Artificial Sequence: Synthetic oligonucleotide
  Target: ATXN1; (+) strand; PAM type: YTN; PAM sequence: CTC
atccagttgaggttttttaa

SEQ ID NO: 300587 - DNA, 20 bp, Artificial Sequence
  Description of Artificial Sequence: Synthetic oligonucleotide
  Target: ATXN1; (+) strand; PAM type: YTN; PAM sequence: TTG
aggttttttaaaatactgtt

SEQ ID NO: 300588 - DNA, 20 bp, Artificial Sequence
  Description of Artificial Sequence: Synthetic oligonucleotide
  Target: ATXN1; (+) strand; PAM type: YTN; PAM sequence: TTT
tttaaaatactgtttttgct

SEQ ID NO: 300589 - DNA, 20 bp, Artificial Sequence
  Description of Artificial Sequence: Synthetic oligonucleotide
  Target: ATXN1; (+) strand; PAM type: YTN; PAM sequence: TTT
ttaaaatactgtttttgctc

SEQ ID NO: 300590 - DNA, 20 bp, Artificial Sequence
  Description of Artificial Sequence: Synthetic oligonucleotide
  Target: ATXN1; (+) strand; PAM type: YTN; PAM sequence: TTT
taaaatactgtttttgctct

SEQ ID NO: 300591 - DNA, 20 bp, Artificial Sequence
  Description of Artificial Sequence: Synthetic oligonucleotide
  Target: ATXN1; (+) strand; PAM type: YTN; PAM sequence: TTT
aaaatactgtttttgctctg

SEQ ID NO: 300592 - DNA, 20 bp, Artificial Sequence
  Description of Artificial Sequence: Synthetic oligonucleotide
  Target: ATXN1; (+) strand; PAM type: YTN; PAM sequence: TTA
aaatactgtttttgctctga

SEQ ID NO: 300593 - DNA, 20 bp, Artificial Sequence
  Description of Artificial Sequence: Synthetic oligonucleotide
  Target: ATXN1; (+) strand; PAM type: YTN; PAM sequence: CTG
tttttgctctgattgggtag

SEQ ID NO: 300594 - DNA, 20 bp, Artificial Sequence
  Description of Artificial Sequence: Synthetic oligonucleotide
  Target: ATXN1; (+) strand; PAM type: YTN; PAM sequence: TTT
ttgctctgattgggtagcct

SEQ ID NO: 300595 - DNA, 20 bp, Artificial Sequence
  Description of Artificial Sequence: Synthetic oligonucleotide
  Target: ATXN1; (+) strand; PAM type: YTN; PAM sequence: TTT
tgctctgattgggtagcctc

SEQ ID NO: 300596 - DNA, 20 bp, Artificial Sequence
  Description of Artificial Sequence: Synthetic oligonucleotide
  Target: ATXN1; (+) strand; PAM type: YTN; PAM sequence: TTT
gctctgattgggtagcctca

SEQ ID NO: 300597 - DNA, 20 bp, Artificial Sequence
  Description of Artificial Sequence: Synthetic oligonucleotide
  Target: ATXN1; (+) strand; PAM type: YTN; PAM sequence: TTG
ctctgattgggtagcctcaa

SEQ ID NO: 300598 - DNA, 20 bp, Artificial Sequence
  Description of Artificial Sequence: Synthetic oligonucleotide
  Target: ATXN1; (+) strand; PAM type: YTN; PAM sequence: CTC
tgattgggtagcctcaaaga

SEQ ID NO: 300599 - DNA, 20 bp, Artificial Sequence
  Description of Artificial Sequence: Synthetic oligonucleotide
  Target: ATXN1; (+) strand; PAM type: YTN; PAM sequence: CTG
attgggtagcctcaaagagg

SEQ ID NO: 300600 - DNA, 20 bp, Artificial Sequence
  Description of Artificial Sequence: Synthetic oligonucleotide
  Target: ATXN1; (+) strand; PAM type: YTN; PAM sequence: TTG
ggtagcctcaaagaggagga

SEQ ID NO: 300601 - DNA, 20 bp, Artificial Sequence
  Description of Artificial Sequence: Synthetic oligonucleotide
  Target: ATXN1; (+) strand; PAM type: YTN; PAM sequence: CTC
aaagaggaggaagagagtca

SEQ ID NO: 300602 - DNA, 20 bp, Artificial Sequence
  Description of Artificial Sequence: Synthetic oligonucleotide
  Target: ATXN1; (+) strand; PAM type: YTN; PAM sequence: CTT
gattcagaatcttcagctct

SEQ ID NO: 300603 - DNA, 20 bp, Artificial Sequence
  Description of Artificial Sequence: Synthetic oligonucleotide
  Target: ATXN1; (+) strand; PAM type: YTN; PAM sequence: TTG
attcagaatcttcagctctc

SEQ ID NO: 300604 - DNA, 20 bp, Artificial Sequence
  Description of Artificial Sequence: Synthetic oligonucleotide
  Target: ATXN1; (+) strand; PAM type: YTN; PAM sequence: TTC
agaatcttcagctctccact

SEQ ID NO: 300605 - DNA, 20 bp, Artificial Sequence
  Description of Artificial Sequence: Synthetic oligonucleotide
  Target: ATXN1; (+) strand; PAM type: YTN; PAM sequence: CTT
cagctctccactctatcagc

SEQ ID NO: 300606 - DNA, 20 bp, Artificial Sequence
  Description of Artificial Sequence: Synthetic oligonucleotide
  Target: ATXN1; (+) strand; PAM type: YTN; PAM sequence: TTC
agctctccactctatcagca

SEQ ID NO: 300607 - DNA, 20 bp, Artificial Sequence
  Description of Artificial Sequence: Synthetic oligonucleotide
  Target: ATXN1; (+) strand; PAM type: YTN; PAM sequence: CTC
tccactctatcagcaacctg

SEQ ID NO: 300608 - DNA, 20 bp, Artificial Sequence
  Description of Artificial Sequence: Synthetic oligonucleotide
  Target: ATXN1; (+) strand; PAM type: YTN; PAM sequence: CTC
cactctatcagcaacctgcc

SEQ ID NO: 300609 - DNA, 20 bp, Artificial Sequence
  Description of Artificial Sequence: Synthetic oligonucleotide
  Target: ATXN1; (+) strand; PAM type: YTN; PAM sequence: CTC
tatcagcaacctgccttcct

SEQ ID NO: 300610 - DNA, 20 bp, Artificial Sequence
  Description of Artificial Sequence: Synthetic oligonucleotide
  Target: ATXN1; (+) strand; PAM type: YTN; PAM sequence: CTA
tcagcaacctgccttccttc

SEQ ID NO: 300611 - DNA, 20 bp, Artificial Sequence
  Description of Artificial Sequence: Synthetic oligonucleotide
  Target: ATXN1; (+) strand; PAM type: YTN; PAM sequence: CTG
ccttccttcaagtctacttg

SEQ ID NO: 300612 - DNA, 20 bp, Artificial Sequence
  Description of Artificial Sequence: Synthetic oligonucleotide
  Target: ATXN1; (+) strand; PAM type: YTN; PAM sequence: CTT
ccttcaagtctacttggccc

SEQ ID NO: 300613 - DNA, 20 bp, Artificial Sequence
  Description of Artificial Sequence: Synthetic oligonucleotide
  Target: ATXN1; (+) strand; PAM type: YTN; PAM sequence: TTC
cttcaagtctacttggccca

SEQ ID NO: 300614 - DNA, 20 bp, Artificial Sequence
  Description of Artificial Sequence: Synthetic oligonucleotide
  Target: ATXN1; (+) strand; PAM type: YTN; PAM sequence: CTT
caagtctacttggcccagtg

SEQ ID NO: 300615 - DNA, 20 bp, Artificial Sequence
  Description of Artificial Sequence: Synthetic oligonucleotide
  Target: ATXN1; (+) strand; PAM type: YTN; PAM sequence: TTC
aagtctacttggcccagtgc

SEQ ID NO: 300616 - DNA, 20 bp, Artificial Sequence
  Description of Artificial Sequence: Synthetic oligonucleotide
  Target: ATXN1; (+) strand; PAM type: YTN; PAM sequence: CTA
cttggcccagtgctgttatt

SEQ ID NO: 300617 - DNA, 20 bp, Artificial Sequence
  Description of Artificial Sequence: Synthetic oligonucleotide
  Target: ATXN1; (+) strand; PAM type: YTN; PAM sequence: CTT
ggcccagtgctgttattcct

SEQ ID NO: 300618 - DNA, 20 bp, Artificial Sequence
  Description of Artificial Sequence: Synthetic oligonucleotide
  Target: ATXN1; (+) strand; PAM type: YTN; PAM sequence: TTG
gcccagtgctgttattcctc

SEQ ID NO: 300619 - DNA, 20 bp, Artificial Sequence
  Description of Artificial Sequence: Synthetic oligonucleotide
  Target: ATXN1; (+) strand; PAM type: YTN; PAM sequence: CTG
ttattcctcctccactggca

SEQ ID NO: 300620 - DNA, 20 bp, Artificial Sequence
  Description of Artificial Sequence: Synthetic oligonucleotide
  Target: ATXN1; (+) strand; PAM type: YTN; PAM sequence: TTA
ttcctcctccactggcaact

SEQ ID NO: 300621 - DNA, 20 bp, Artificial Sequence
  Description of Artificial Sequence: Synthetic oligonucleotide
  Target: ATXN1; (+) strand; PAM type: YTN; PAM sequence: TTC
ctcctccactggcaactaga

SEQ ID NO: 300622 - DNA, 20 bp, Artificial Sequence
  Description of Artificial Sequence: Synthetic oligonucleotide
  Target: ATXN1; (+) strand; PAM type: YTN; PAM sequence: CTC
ctccactggcaactagatgt

SEQ ID NO: 300623 - DNA, 20 bp, Artificial Sequence
  Description of Artificial Sequence: Synthetic oligonucleotide
  Target: ATXN1; (+) strand; PAM type: YTN; PAM sequence: CTC
cactggcaactagatgtgtg

SEQ ID NO: 300624 - DNA, 20 bp, Artificial Sequence
  Description of Artificial Sequence: Synthetic oligonucleotide
  Target: ATXN1; (+) strand; PAM type: YTN; PAM sequence: CTG
gcaactagatgtgtgagtga

SEQ ID NO: 300625 - DNA, 20 bp, Artificial Sequence
  Description of Artificial Sequence: Synthetic oligonucleotide
  Target: ATXN1; (+) strand; PAM type: YTN; PAM sequence: CTA
gatgtgtgagtgacattgat

SEQ ID NO: 300626 - DNA, 20 bp, Artificial Sequence
  Description of Artificial Sequence: Synthetic oligonucleotide
  Target: ATXN1; (+) strand; PAM type: YTN; PAM sequence: TTG
attcctattaccagagggat

SEQ ID NO: 300627 - DNA, 20 bp, Artificial Sequence
  Description of Artificial Sequence: Synthetic oligonucleotide
  Target: ATXN1; (+) strand; PAM type: YTN; PAM sequence: TTC
ctattaccagagggattaac

SEQ ID NO: 300628 - DNA, 20 bp, Artificial Sequence
  Description of Artificial Sequence: Synthetic oligonucleotide
  Target: ATXN1; (+) strand; PAM type: YTN; PAM sequence: CTA
ttaccagagggattaactcc

SEQ ID NO: 300629 - DNA, 20 bp, Artificial Sequence
  Description of Artificial Sequence: Synthetic oligonucleotide
  Target: ATXN1; (+) strand; PAM type: YTN; PAM sequence: TTA
ccagagggattaactccaaa

SEQ ID NO: 300630 - DNA, 20 bp, Artificial Sequence
  Description of Artificial Sequence: Synthetic oligonucleotide
  Target: ATXN1; (+) strand; PAM type: YTN; PAM sequence: TTA
actccaaagttctcttgaag

SEQ ID NO: 300631 - DNA, 20 bp, Artificial Sequence
  Description of Artificial Sequence: Synthetic oligonucleotide
  Target: ATXN1; (+) strand; PAM type: YTN; PAM sequence: CTC
caaagttctcttgaaggttt

SEQ ID NO: 300632 - DNA, 20 bp, Artificial Sequence
  Description of Artificial Sequence: Synthetic oligonucleotide
  Target: ATXN1; (+) strand; PAM type: YTN; PAM sequence: TTC
tcttgaaggttttacagttc

SEQ ID NO: 300633 - DNA, 20 bp, Artificial Sequence
  Description of Artificial Sequence: Synthetic oligonucleotide
  Target: ATXN1; (+) strand; PAM type: YTN; PAM sequence: CTC
ttgaaggttttacagttctt

SEQ ID NO: 300634 - DNA, 20 bp, Artificial Sequence
  Description of Artificial Sequence: Synthetic oligonucleotide
  Target: ATXN1; (+) strand; PAM type: YTN; PAM sequence: CTT
gaaggttttacagttctttt

SEQ ID NO: 300635 - DNA, 20 bp, Artificial Sequence
  Description of Artificial Sequence: Synthetic oligonucleotide
  Target: ATXN1; (+) strand; PAM type: YTN; PAM sequence: TTG
aaggttttacagttcttttc

SEQ ID NO: 300636 - DNA, 20 bp, Artificial Sequence
  Description of Artificial Sequence: Synthetic oligonucleotide
  Target: ATXN1; (+) strand; PAM type: YTN; PAM sequence: TTT
tacagttcttttccagcagt

SEQ ID NO: 300637 - DNA, 20 bp, Artificial Sequence
  Description of Artificial Sequence: Synthetic oligonucleotide
  Target: ATXN1; (+) strand; PAM type: YTN; PAM sequence: TTT
acagttcttttccagcagtt

SEQ ID NO: 300638 - DNA, 20 bp, Artificial Sequence
  Description of Artificial Sequence: Synthetic oligonucleotide
  Target: ATXN1; (+) strand; PAM type: YTN; PAM sequence: TTA
cagttcttttccagcagttc

SEQ ID NO: 300639 - DNA, 20 bp, Artificial Sequence
  Description of Artificial Sequence: Synthetic oligonucleotide
  Target: ATXN1; (+) strand; PAM type: YTN; PAM sequence: TTC
ttttccagcagttcctcatt

SEQ ID NO: 300640 - DNA, 20 bp, Artificial Sequence
  Description of Artificial Sequence: Synthetic oligonucleotide
  Target: ATXN1; (+) strand; PAM type: YTN; PAM sequence: CTT
ttccagcagttcctcattct

SEQ ID NO: 300641 - DNA, 20 bp, Artificial Sequence
  Description of Artificial Sequence: Synthetic oligonucleotide
  Target: ATXN1; (+) strand; PAM type: YTN; PAM sequence: TTT
tccagcagttcctcattctt

SEQ ID NO: 300642 - DNA, 20 bp, Artificial Sequence
  Description of Artificial Sequence: Synthetic oligonucleotide
  Target: ATXN1; (+) strand; PAM type: YTN; PAM sequence: TTT
ccagcagttcctcattcttc

SEQ ID NO: 300643 - DNA, 20 bp, Artificial Sequence
  Description of Artificial Sequence: Synthetic oligonucleotide
  Target: ATXN1; (+) strand; PAM type: YTN; PAM sequence: TTC
cagcagttcctcattcttca

SEQ ID NO: 300644 - DNA, 20 bp, Artificial Sequence
  Description of Artificial Sequence: Synthetic oligonucleotide
  Target: ATXN1; (+) strand; PAM type: YTN; PAM sequence: TTC
ctcattcttcaaaggtaatt

SEQ ID NO: 300645 - DNA, 20 bp, Artificial Sequence
  Description of Artificial Sequence: Synthetic oligonucleotide
  Target: ATXN1; (+) strand; PAM type: YTN; PAM sequence: CTC
attcttcaaaggtaattaac

SEQ ID NO: 300646 - DNA, 20 bp, Artificial Sequence
  Description of Artificial Sequence: Synthetic oligonucleotide
  Target: ATXN1; (+) strand; PAM type: YTN; PAM sequence: TTC
ttcaaaggtaattaacctct

SEQ ID NO: 300647 - DNA, 20 bp, Artificial Sequence
  Description of Artificial Sequence: Synthetic oligonucleotide
  Target: ATXN1; (+) strand; PAM type: YTN; PAM sequence: CTT
caaaggtaattaacctcttg

SEQ ID NO: 300648 - DNA, 20 bp, Artificial Sequence
  Description of Artificial Sequence: Synthetic oligonucleotide
  Target: ATXN1; (+) strand; PAM type: YTN; PAM sequence: TTC
aaaggtaattaacctcttga

SEQ ID NO: 300649 - DNA, 20 bp, Artificial Sequence
  Description of Artificial Sequence: Synthetic oligonucleotide
  Target: ATXN1; (+) strand; PAM type: YTN; PAM sequence: TTA
acctcttgatgggcttacag

SEQ ID NO: 300650 - DNA, 20 bp, Artificial Sequence
  Description of Artificial Sequence: Synthetic oligonucleotide
  Target: ATXN1; (+) strand; PAM type: YTN; PAM sequence: CTC
ttgatgggcttacagcagaa

SEQ ID NO: 300651 - DNA, 20 bp, Artificial Sequence
  Description of Artificial Sequence: Synthetic oligonucleotide
  Target: ATXN1; (+) strand; PAM type: YTN; PAM sequence: CTT
gatgggcttacagcagaagc

SEQ ID NO: 300652 - DNA, 20 bp, Artificial Sequence
  Description of Artificial Sequence: Synthetic oligonucleotide
  Target: ATXN1; (+) strand; PAM type: YTN; PAM sequence: TTG
atgggcttacagcagaagca

SEQ ID NO: 300653 - DNA, 20 bp, Artificial Sequence
  Description of Artificial Sequence: Synthetic oligonucleotide
  Target: ATXN1; (+) strand; PAM type: YTN; PAM sequence: CTT
acagcagaagcagtgttaga

SEQ ID NO: 300654 - DNA, 20 bp, Artificial Sequence
  Description of Artificial Sequence: Synthetic oligonucleotide
  Target: ATXN1; (+) strand; PAM type: YTN; PAM sequence: TTA
cagcagaagcagtgttagaa

SEQ ID NO: 300655 - DNA, 20 bp, Artificial Sequence
  Description of Artificial Sequence: Synthetic oligonucleotide
  Target: ATXN1; (+) strand; PAM type: YTN; PAM sequence: TTA
gaagtcccaacacattgatg

SEQ ID NO: 300656 - DNA, 20 bp, Artificial Sequence
  Description of Artificial Sequence: Synthetic oligonucleotide
  Target: ATXN1; (+) strand; PAM type: YTN; PAM sequence: TTG
atgatatgttataaaccagg

SEQ ID NO: 300657 - DNA, 20 bp, Artificial Sequence
  Description of Artificial Sequence: Synthetic oligonucleotide
  Target: ATXN1; (+) strand; PAM type: YTN; PAM sequence: TTA
taaaccaggggagaggataa

SEQ ID NO: 300658 - DNA, 20 bp, Artificial Sequence
  Description of Artificial Sequence: Synthetic oligonucleotide
  Target: ATXN1; (+) strand; PAM type: YTN; PAM sequence: TTG
gaaaatgtatttccagcctc

SEQ ID NO: 300659 - DNA, 20 bp, Artificial Sequence
  Description of Artificial Sequence: Synthetic oligonucleotide
  Target: ATXN1; (+) strand; PAM type: YTN; PAM sequence: TTT
ccagcctcattggaaaatat

SEQ ID NO: 300660 - DNA, 20 bp, Artificial Sequence
  Description of Artificial Sequence: Synthetic oligonucleotide
  Target: ATXN1; (+) strand; PAM type: YTN; PAM sequence: TTC
cagcctcattggaaaatata

SEQ ID NO: 300661 - DNA, 20 bp, Artificial Sequence
  Description of Artificial Sequence: Synthetic oligonucleotide
  Target: ATXN1; (+) strand; PAM type: YTN; PAM sequence: CTC
attggaaaatatatttccat

SEQ ID NO: 300662 - DNA, 20 bp, Artificial Sequence
  Description of Artificial Sequence: Synthetic oligonucleotide
  Target: ATXN1; (+) strand; PAM type: YTN; PAM sequence: TTG
gaaaatatatttccatttat

SEQ ID NO: 300663 - DNA, 20 bp, Artificial Sequence
  Description of Artificial Sequence: Synthetic oligonucleotide
  Target: ATXN1; (+) strand; PAM type: YTN; PAM sequence: TTT
ccatttattgagaaaaagta

SEQ ID NO: 300664 - DNA, 20 bp, Artificial Sequence
  Description of Artificial Sequence: Synthetic oligonucleotide
  Target: ATXN1; (+) strand; PAM type: YTN; PAM sequence: TTC
catttattgagaaaaagtaa

SEQ ID NO: 300665 - DNA, 20 bp, Artificial Sequence
  Description of Artificial Sequence: Synthetic oligonucleotide
  Target: ATXN1; (+) strand; PAM type: YTN; PAM sequence: TTT
attgagaaaaagtaactcaa

SEQ ID NO: 300666 - DNA, 20 bp, Artificial Sequence
  Description of Artificial Sequence: Synthetic oligonucleotide
  Target: ATXN1; (+) strand; PAM type: YTN; PAM sequence: TTA
ttgagaaaaagtaactcaag

SEQ ID NO: 300667 - DNA, 20 bp, Artificial Sequence
  Description of Artificial Sequence: Synthetic oligonucleotide
  Target: ATXN1; (+) strand; PAM type: YTN; PAM sequence: TTG
agaaaaagtaactcaagtgt

SEQ ID NO: 300668 - DNA, 20 bp, Artificial Sequence
  Description of Artificial Sequence: Synthetic oligonucleotide
  Target: ATXN1; (+) strand; PAM type: YTN; PAM sequence: CTC
aagtgtttaggaacatatga

SEQ ID NO: 300669 - DNA, 20 bp, Artificial Sequence
  Description of Artificial Sequence: Synthetic oligonucleotide
  Target: ATXN1; (+) strand; PAM type: YTN; PAM sequence: TTT
aggaacatatgaatcacaga

SEQ ID NO: 300670 - DNA, 20 bp, Artificial Sequence
  Description of Artificial Sequence: Synthetic oligonucleotide
  Target: ATXN1; (+) strand; PAM type: YTN; PAM sequence: TTA
ggaacatatgaatcacagaa

SEQ ID NO: 300671 - DNA, 20 bp, Artificial Sequence
  Description of Artificial Sequence: Synthetic oligonucleotide
  Target: ATXN1; (+) strand; PAM type: YTN; PAM sequence: TTG
tagattggcagaggccttag

SEQ ID NO: 300672 - DNA, 20 bp, Artificial Sequence
  Description of Artificial Sequence: Synthetic oligonucleotide
  Target: ATXN1; (+) strand; PAM type: YTN; PAM sequence: TTG
gcagaggccttagaaaacca

SEQ ID NO: 300673 - DNA, 20 bp, Artificial Sequence
  Description of Artificial Sequence: Synthetic oligonucleotide
  Target: ATXN1; (+) strand; PAM type: YTN; PAM sequence: CTT
agaaaaccatgctatttcga

SEQ ID NO: 300674 - DNA, 20 bp, Artificial Sequence
  Description of Artificial Sequence: Synthetic oligonucleotide
  Target: ATXN1; (+) strand; PAM type: YTN; PAM sequence: TTA
gaaaaccatgctatttcgac

SEQ ID NO: 300675 - DNA, 20 bp, Artificial Sequence
  Description of Artificial Sequence: Synthetic oligonucleotide
  Target: ATXN1; (+) strand; PAM type: YTN; PAM sequence: CTA
tttcgacttctactaataat

SEQ ID NO: 300676 - DNA, 20 bp, Artificial Sequence
  Description of Artificial Sequence: Synthetic oligonucleotide
  Target: ATXN1; (+) strand; PAM type: YTN; PAM sequence: TTT
cgacttctactaataatgag

SEQ ID NO: 300677 - DNA, 20 bp, Artificial Sequence
  Description of Artificial Sequence: Synthetic oligonucleotide
  Target: ATXN1; (+) strand; PAM type: YTN; PAM sequence: TTC
gacttctactaataatgaga

SEQ ID NO: 300678 - DNA, 20 bp, Artificial Sequence
  Description of Artificial Sequence: Synthetic oligonucleotide
  Target: ATXN1; (+) strand; PAM type: YTN; PAM sequence: CTT
ctactaataatgagaaaacg

SEQ ID NO: 300679 - DNA, 20 bp, Artificial Sequence
  Description of Artificial Sequence: Synthetic oligonucleotide
  Target: ATXN1; (+) strand; PAM type: YTN; PAM sequence: TTC
tactaataatgagaaaacgg

SEQ ID NO: 300680 - DNA, 20 bp, Artificial Sequence
  Description of Artificial Sequence: Synthetic oligonucleotide
  Target: ATXN1; (+) strand; PAM type: YTN; PAM sequence: CTA
ctaataatgagaaaacggag

SEQ ID NO: 300681 - DNA, 20 bp, Artificial Sequence
  Description of Artificial Sequence: Synthetic oligonucleotide
  Target: ATXN1; (+) strand; PAM type: YTN; PAM sequence: CTA
ataatgagaaaacggaggtg

SEQ ID NO: 300682 - DNA, 20 bp, Artificial Sequence
  Description of Artificial Sequence: Synthetic oligonucleotide
  Target: ATXN1; (+) strand; PAM type: YTN; PAM sequence: CTG
ccgagccacagttacccaac

SEQ ID NO: 300683 - DNA, 20 bp, Artificial Sequence
  Description of Artificial Sequence: Synthetic oligonucleotide
  Target: ATXN1; (+) strand; PAM type: YTN; PAM sequence: TTA
cccaaccagcaccaatgtag

SEQ ID NO: 300684 - DNA, 20 bp, Artificial Sequence
  Description of Artificial Sequence: Synthetic oligonucleotide
  Target: ATXN1; (+) strand; PAM type: YTN; PAM sequence: CTG
cctggagcgagacctgacca

SEQ ID NO: 300685 - DNA, 20 bp, Artificial Sequence
  Description of Artificial Sequence: Synthetic oligonucleotide
  Target: ATXN1; (+) strand; PAM type: YTN; PAM sequence: CTG
gagcgagacctgaccatact

SEQ ID NO: 300686 - DNA, 20 bp, Artificial Sequence
  Description of Artificial Sequence: Synthetic oligonucleotide
  Target: ATXN1; (+) strand; PAM type: YTN; PAM sequence: CTG
accatactgtggggcagaat

SEQ ID NO: 300687 - DNA, 20 bp, Artificial Sequence
  Description of Artificial Sequence: Synthetic oligonucleotide
  Target: ATXN1; (+) strand; PAM type: YTN; PAM sequence: CTG
tggggcagaatctcccctcc

SEQ ID NO: 300688 - DNA, 20 bp, Artificial Sequence
  Description of Artificial Sequence: Synthetic oligonucleotide
  Target: ATXN1; (+) strand; PAM type: YTN; PAM sequence: CTC
ccctccaatccccttcataa

SEQ ID NO: 300689 - DNA, 20 bp, Artificial Sequence
  Description of Artificial Sequence: Synthetic oligonucleotide
  Target: ATXN1; (+) strand; PAM type: YTN; PAM sequence: CTC
caatccccttcataaagcac

SEQ ID NO: 300690 - DNA, 20 bp, Artificial Sequence
  Description of Artificial Sequence: Synthetic oligonucleotide
  Target: ATXN1; (+) strand; PAM type: YTN; PAM sequence: CTT
cataaagcacgatgatgctg

SEQ ID NO: 300691 - DNA, 20 bp, Artificial Sequence
  Description of Artificial Sequence: Synthetic oligonucleotide
  Target: ATXN1; (+) strand; PAM type: YTN; PAM sequence: TTC
ataaagcacgatgatgctgt

SEQ ID NO: 300692 - DNA, 20 bp, Artificial Sequence
  Description of Artificial Sequence: Synthetic oligonucleotide
  Target: ATXN1; (+) strand; PAM type: YTN; PAM sequence: CTG
ttcaaacacaacctgtgcct

SEQ ID NO: 300693 - DNA, 20 bp, Artificial Sequence
  Description of Artificial Sequence: Synthetic oligonucleotide
  Target: ATXN1; (+) strand; PAM type: YTN; PAM sequence: TTC
aaacacaacctgtgcctcct

SEQ ID NO: 300694 - DNA, 20 bp, Artificial Sequence
  Description of Artificial Sequence: Synthetic oligonucleotide
  Target: ATXN1; (+) strand; PAM type: YTN; PAM sequence: CTG
tgcctcctgtccttagagcc

SEQ ID NO: 300695 - DNA, 20 bp, Artificial Sequence
  Description of Artificial Sequence: Synthetic oligonucleotide
  Target: ATXN1; (+) strand; PAM type: YTN; PAM sequence: CTC
ctgtccttagagccccagat

SEQ ID NO: 300696 - DNA, 20 bp, Artificial Sequence
  Description of Artificial Sequence: Synthetic oligonucleotide
  Target: ATXN1; (+) strand; PAM type: YTN; PAM sequence: CTG
tccttagagccccagatttc

SEQ ID NO: 300697 - DNA, 20 bp, Artificial Sequence
  Description of Artificial Sequence: Synthetic oligonucleotide
  Target: ATXN1; (+) strand; PAM type: YTN; PAM sequence: CTT
agagccccagatttcatttt

SEQ ID NO: 300698 - DNA, 20 bp, Artificial Sequence
  Description of Artificial Sequence: Synthetic oligonucleotide
  Target: ATXN1; (+) strand; PAM type: YTN; PAM sequence: TTA
gagccccagatttcatttta

SEQ ID NO: 300699 - DNA, 20 bp, Artificial Sequence
  Description of Artificial Sequence: Synthetic oligonucleotide
  Target: ATXN1; (+) strand; PAM type: YTN; PAM sequence: TTT
cattttaggagaggattacg

SEQ ID NO: 300700 - DNA, 20 bp, Artificial Sequence
  Description of Artificial Sequence: Synthetic oligonucleotide
  Target: ATXN1; (+) strand; PAM type: YTN; PAM sequence: TTC
attttaggagaggattacga

SEQ ID NO: 300701 - DNA, 20 bp, Artificial Sequence
  Description of Artificial Sequence: Synthetic oligonucleotide
  Target: ATXN1; (+) strand; PAM type: YTN; PAM sequence: TTT
taggagaggattacgaaata

SEQ ID NO: 300702 - DNA, 20 bp, Artificial Sequence
  Description of Artificial Sequence: Synthetic oligonucleotide
  Target: ATXN1; (+) strand; PAM type: YTN; PAM sequence: TTT
aggagaggattacgaaataa

SEQ ID NO: 300703 - DNA, 20 bp, Artificial Sequence
  Description of Artificial Sequence: Synthetic oligonucleotide
  Target: ATXN1; (+) strand; PAM type: YTN; PAM sequence: TTA
ggagaggattacgaaataat

SEQ ID NO: 300704 - DNA, 20 bp, Artificial Sequence
  Description of Artificial Sequence: Synthetic oligonucleotide
  Target: ATXN1; (+) strand; PAM type: YTN; PAM sequence: TTA
cgaaataatgactaagctct

SEQ ID NO: 300705 - DNA, 20 bp, Artificial Sequence
  Description of Artificial Sequence: Synthetic oligonucleotide
  Target: ATXN1; (+) strand; PAM type: YTN; PAM sequence: CTA
agctctgaaaactgagaatg

SEQ ID NO: 300706 - DNA, 20 bp, Artificial Sequence
  Description of Artificial Sequence: Synthetic oligonucleotide
  Target: ATXN1; (+) strand; PAM type: YTN; PAM sequence: CTC
tgaaaactgagaatgagaca

SEQ ID NO: 300707 - DNA, 20 bp, Artificial Sequence
  Description of Artificial Sequence: Synthetic oligonucleotide
  Target: ATXN1; (+) strand; PAM type: YTN; PAM sequence: CTG
aaaactgagaatgagacaaa

SEQ ID NO: 300708 - DNA, 20 bp, Artificial Sequence
  Description of Artificial Sequence: Synthetic oligonucleotide
  Target: ATXN1; (+) strand; PAM type: YTN; PAM sequence: CTG
agaatgagacaaaggaagaa

SEQ ID NO: 300709 - DNA, 20 bp, Artificial Sequence
  Description of Artificial Sequence: Synthetic oligonucleotide
  Target: ATXN1; (+) strand; PAM type: YTN; PAM sequence: CTT
attgtagtgtttgcaatcac

SEQ ID NO: 300710 - DNA, 20 bp, Artificial Sequence
  Description of Artificial Sequence: Synthetic oligonucleotide
  Target: ATXN1; (+) strand; PAM type: YTN; PAM sequence: TTA
ttgtagtgtttgcaatcact

SEQ ID NO: 300711 - DNA, 20 bp, Artificial Sequence
  Description of Artificial Sequence: Synthetic oligonucleotide
  Target: ATXN1; (+) strand; PAM type: YTN; PAM sequence: TTG
tagtgtttgcaatcactact

SEQ ID NO: 300712 - DNA, 20 bp, Artificial Sequence
  Description of Artificial Sequence: Synthetic oligonucleotide
  Target: ATXN1; (+) strand; PAM type: YTN; PAM sequence: TTT
gcaatcactacttgtgcctt

SEQ ID NO: 300713 - DNA, 20 bp, Artificial Sequence
  Description of Artificial Sequence: Synthetic oligonucleotide
  Target: ATXN1; (+) strand; PAM type: YTN; PAM sequence: TTG
caatcactacttgtgccttt

SEQ ID NO: 300714 - DNA, 20 bp, Artificial Sequence
  Description of Artificial Sequence: Synthetic oligonucleotide
  Target: ATXN1; (+) strand; PAM type: YTN; PAM sequence: CTA
cttgtgcctttcattacatt

SEQ ID NO: 300715 - DNA, 20 bp, Artificial Sequence
  Description of Artificial Sequence: Synthetic oligonucleotide
  Target: ATXN1; (+) strand; PAM type: YTN; PAM sequence: CTT
gtgcctttcattacatttaa

SEQ ID NO: 300716 - DNA, 20 bp, Artificial Sequence
  Description of Artificial Sequence: Synthetic oligonucleotide
  Target: ATXN1; (+) strand; PAM type: YTN; PAM sequence: TTG
tgcctttcattacatttaaa

SEQ ID NO: 300717 - DNA, 20 bp, Artificial Sequence
  Description of Artificial Sequence: Synthetic oligonucleotide
  Target: ATXN1; (+) strand; PAM type: YTN; PAM sequence: CTT
tcattacatttaaatgcatg

SEQ ID NO: 300718 - DNA, 20 bp, Artificial Sequence
  Description of Artificial Sequence: Synthetic oligonucleotide
  Target: ATXN1; (+) strand; PAM type: YTN; PAM sequence: TTT
cattacatttaaatgcatgt

SEQ ID NO: 300719 - DNA, 20 bp, Artificial Sequence
  Description of Artificial Sequence: Synthetic oligonucleotide
  Target: ATXN1; (+) strand; PAM type: YTN; PAM sequence: TTC
attacatttaaatgcatgtc

SEQ ID NO: 300720 - DNA, 20 bp, Artificial Sequence
  Description of Artificial Sequence: Synthetic oligonucleotide
  Target: ATXN1; (+) strand; PAM type: YTN; PAM sequence: TTA
catttaaatgcatgtcgaaa

SEQ ID NO: 300721 - DNA, 20 bp, Artificial Sequence
  Description of Artificial Sequence: Synthetic oligonucleotide
  Target: ATXN1; (+) strand; PAM type: YTN; PAM sequence: TTT
aaatgcatgtcgaaatgaca

SEQ ID NO: 300722 - DNA, 20 bp, Artificial Sequence
  Description of Artificial Sequence: Synthetic oligonucleotide
  Target: ATXN1; (+) strand; PAM type: YTN; PAM sequence: TTA
aatgcatgtcgaaatgacat

SEQ ID NO: 300723 - DNA, 20 bp, Artificial Sequence
  Description of Artificial Sequence: Synthetic oligonucleotide
  Target: ATXN1; (+) strand; PAM type: YTN; PAM sequence: CTT
catgcattctgcagtgaaaa

SEQ ID NO: 300724 - DNA, 20 bp, Artificial Sequence
  Description of Artificial Sequence: Synthetic oligonucleotide
  Target: ATXN1; (+) strand; PAM type: YTN; PAM sequence: TTC
atgcattctgcagtgaaaaa

SEQ ID NO: 300725 - DNA, 20 bp, Artificial Sequence
  Description of Artificial Sequence: Synthetic oligonucleotide
  Target: ATXN1; (+) strand; PAM type: YTN; PAM sequence: TTC
tgcagtgaaaaagatggtgc

SEQ ID NO: 300726 - DNA, 20 bp, Artificial Sequence
  Description of Artificial Sequence: Synthetic oligonucleotide
  Target: ATXN1; (+) strand; PAM type: YTN; PAM sequence: CTG
cagtgaaaaagatggtgcca

SEQ ID NO: 300727 - DNA, 20 bp, Artificial Sequence
  Description of Artificial Sequence: Synthetic oligonucleotide
  Target: ATXN1; (+) strand; PAM type: YTN; PAM sequence: TTG
gaatttcattgtaagtgtcg

SEQ ID NO: 300728 - DNA, 20 bp, Artificial Sequence
  Description of Artificial Sequence: Synthetic oligonucleotide
  Target: ATXN1; (+) strand; PAM type: YTN; PAM sequence: TTT
cattgtaagtgtcgcagaaa

SEQ ID NO: 300729 - DNA, 20 bp, Artificial Sequence
  Description of Artificial Sequence: Synthetic oligonucleotide
  Target: ATXN1; (+) strand; PAM type: YTN; PAM sequence: TTC
attgtaagtgtcgcagaaat

SEQ ID NO: 300730 - DNA, 20 bp, Artificial Sequence
  Description of Artificial Sequence: Synthetic oligonucleotide
  Target: ATXN1; (+) strand; PAM type: YTN; PAM sequence: TTG
taagtgtcgcagaaatatcc

SEQ ID NO: 300731 - DNA, 20 bp, Artificial Sequence
  Description of Artificial Sequence: Synthetic oligonucleotide
  Target: ATXN1; (+) strand; PAM type: YTN; PAM sequence: CTT
tggaatcaggtcccaaatca

SEQ ID NO: 300732 - DNA, 20 bp, Artificial Sequence
  Description of Artificial Sequence: Synthetic oligonucleotide
  Target: ATXN1; (+) strand; PAM type: YTN; PAM sequence: TTT
ggaatcaggtcccaaatcat

SEQ ID NO: 300733 - DNA, 20 bp, Artificial Sequence
  Description of Artificial Sequence: Synthetic oligonucleotide
  Target: ATXN1; (+) strand; PAM type: YTN; PAM sequence: TTG
gaatcaggtcccaaatcatt

SEQ ID NO: 300734 - DNA, 20 bp, Artificial Sequence
  Description of Artificial Sequence: Synthetic oligonucleotide
  Target: ATXN1; (+) strand; PAM type: YTN; PAM sequence: TTA
tttgctccttttatcattgt

SEQ ID NO: 300735 - DNA, 20 bp, Artificial Sequence
  Description of Artificial Sequence: Synthetic oligonucleotide
  Target: ATXN1; (+) strand; PAM type: YTN; PAM sequence: TTT
gctccttttatcattgtcat

SEQ ID NO: 300736 - DNA, 20 bp, Artificial Sequence
  Description of Artificial Sequence: Synthetic oligonucleotide
  Target: ATXN1; (+) strand; PAM type: YTN; PAM sequence: TTG
ctccttttatcattgtcatc

SEQ ID NO: 300737 - DNA, 20 bp, Artificial Sequence
  Description of Artificial Sequence: Synthetic oligonucleotide
  Target: ATXN1; (+) strand; PAM type: YTN; PAM sequence: CTC
cttttatcattgtcatcatc

SEQ ID NO: 300738 - DNA, 20 bp, Artificial Sequence
  Description of Artificial Sequence: Synthetic oligonucleotide
  Target: ATXN1; (+) strand; PAM type: YTN; PAM sequence: CTT
ttatcattgtcatcatcgtg

SEQ ID NO: 300739 - DNA, 20 bp, Artificial Sequence
  Description of Artificial Sequence: Synthetic oligonucleotide
  Target: ATXN1; (+) strand; PAM type: YTN; PAM sequence: TTT
tatcattgtcatcatcgtgt

SEQ ID NO: 300740 - DNA, 20 bp, Artificial Sequence
  Description of Artificial Sequence: Synthetic oligonucleotide
  Target: ATXN1; (+) strand; PAM type: YTN; PAM sequence: TTT
atcattgtcatcatcgtgta

SEQ ID NO: 300741 - DNA, 20 bp, Artificial Sequence
  Description of Artificial Sequence: Synthetic oligonucleotide
  Target: ATXN1; (+) strand; PAM type: YTN; PAM sequence: TTA
tcattgtcatcatcgtgtat

SEQ ID NO: 300742 - DNA, 20 bp, Artificial Sequence
  Description of Artificial Sequence: Synthetic oligonucleotide
  Target: ATXN1; (+) strand; PAM type: YTN; PAM sequence: TTG
tcatcatcgtgtatcatggc

SEQ ID NO: 300743 - DNA, 20 bp, Artificial Sequence
  Description of Artificial Sequence: Synthetic oligonucleotide
  Target: ATXN1; (+) strand; PAM type: YTN; PAM sequence: CTC
cctgaggggaggagctctgt

SEQ ID NO: 300744 - DNA, 20 bp, Artificial Sequence
  Description of Artificial Sequence: Synthetic oligonucleotide
  Target: ATXN1; (+) strand; PAM type: YTN; PAM sequence: CTG
aggggaggagctctgtctgt

SEQ ID NO: 300745 - DNA, 20 bp, Artificial Sequence
  Description of Artificial Sequence: Synthetic oligonucleotide
  Target: ATXN1; (+) strand; PAM type: YTN; PAM sequence: CTC
tgtctgtcttgttcactatc

SEQ ID NO: 300746 - DNA, 20 bp, Artificial Sequence
  Description of Artificial Sequence: Synthetic oligonucleotide
  Target: ATXN1; (+) strand; PAM type: YTN; PAM sequence: CTG
tctgtcttgttcactatcat

SEQ ID NO: 300747 - DNA, 20 bp, Artificial Sequence
  Description of Artificial Sequence: Synthetic oligonucleotide
  Target: ATXN1; (+) strand; PAM type: YTN; PAM sequence: CTG
tcttgttcactatcatattc

SEQ ID NO: 300748 - DNA, 20 bp, Artificial Sequence
  Description of Artificial Sequence: Synthetic oligonucleotide
  Target: ATXN1; (+) strand; PAM type: YTN; PAM sequence: CTT
gttcactatcatattcctta

SEQ ID NO: 300749 - DNA, 20 bp, Artificial Sequence
  Description of Artificial Sequence: Synthetic oligonucleotide
  Target: ATXN1; (+) strand; PAM type: YTN; PAM sequence: TTG
ttcactatcatattccttac

SEQ ID NO: 300750 - DNA, 20 bp, Artificial Sequence
  Description of Artificial Sequence: Synthetic oligonucleotide
  Target: ATXN1; (+) strand; PAM type: YTN; PAM sequence: TTC
actatcatattccttacacc

SEQ ID NO: 300751 - DNA, 20 bp, Artificial Sequence
  Description of Artificial Sequence: Synthetic oligonucleotide
  Target: ATXN1; (+) strand; PAM type: YTN; PAM sequence: CTA
tcatattccttacacctacg

SEQ ID NO: 300752 - DNA, 20 bp, Artificial Sequence
  Description of Artificial Sequence: Synthetic oligonucleotide
  Target: ATXN1; (+) strand; PAM type: YTN; PAM sequence: TTC
cttacacctacggcatccat

SEQ ID NO: 300753 - DNA, 20 bp, Artificial Sequence
  Description of Artificial Sequence: Synthetic oligonucleotide
  Target: ATXN1; (+) strand; PAM type: YTN; PAM sequence: CTT
acacctacggcatccatggg

SEQ ID NO: 300754 - DNA, 20 bp, Artificial Sequence
  Description of Artificial Sequence: Synthetic oligonucleotide
  Target: ATXN1; (+) strand; PAM type: YTN; PAM sequence: TTA
cacctacggcatccatggga

SEQ ID NO: 300755 - DNA, 20 bp, Artificial Sequence
  Description of Artificial Sequence: Synthetic oligonucleotide
  Target: ATXN1; (+) strand; PAM type: YTN; PAM sequence: CTA
cggcatccatgggacaagct

SEQ ID NO: 300756 - DNA, 20 bp, Artificial Sequence
  Description of Artificial Sequence: Synthetic oligonucleotide
  Target: ATXN1; (+) strand; PAM type: YTN; PAM sequence: CTA
agtaaaatttactgaaaggc

SEQ ID NO: 300757 - DNA, 20 bp, Artificial Sequence
  Description of Artificial Sequence: Synthetic oligonucleotide
  Target: ATXN1; (+) strand; PAM type: YTN; PAM sequence: TTT
actgaaaggctgaataaaaa

SEQ ID NO: 300758 - DNA, 20 bp, Artificial Sequence
  Description of Artificial Sequence: Synthetic oligonucleotide
  Target: ATXN1; (+) strand; PAM type: YTN; PAM sequence: TTA
ctgaaaggctgaataaaaac

SEQ ID NO: 300759 - DNA, 20 bp, Artificial Sequence
  Description of Artificial Sequence: Synthetic oligonucleotide
  Target: ATXN1; (+) strand; PAM type: YTN; PAM sequence: CTG
aaaggctgaataaaaacttc

SEQ ID NO: 300760 - DNA, 20 bp, Artificial Sequence
  Description of Artificial Sequence: Synthetic oligonucleotide
  Target: ATXN1; (+) strand; PAM type: YTN; PAM sequence: CTG
aataaaaacttccacatgga

SEQ ID NO: 300761 - DNA, 20 bp, Artificial Sequence
  Description of Artificial Sequence: Synthetic oligonucleotide
  Target: ATXN1; (+) strand; PAM type: YTN; PAM sequence: CTT
ccacatggaatgaagaagaa

SEQ ID NO: 300762 - DNA, 20 bp, Artificial Sequence
  Description of Artificial Sequence: Synthetic oligonucleotide
  Target: ATXN1; (+) strand; PAM type: YTN; PAM sequence: TTC
cacatggaatgaagaagaaa

SEQ ID NO: 300763 - DNA, 20 bp, Artificial Sequence
  Description of Artificial Sequence: Synthetic oligonucleotide
  Target: ATXN1; (+) strand; PAM type: YTN; PAM sequence: TTT
gaaaatgcatatgcagtatt

SEQ ID NO: 300764 - DNA, 20 bp, Artificial Sequence
  Description of Artificial Sequence: Synthetic oligonucleotide
  Target: ATXN1; (+) strand; PAM type: YTN; PAM sequence: TTG
aaaatgcatatgcagtatta

SEQ ID NO: 300765 - DNA, 20 bp, Artificial Sequence
  Description of Artificial Sequence: Synthetic oligonucleotide
  Target: ATXN1; (+) strand; PAM type: YTN; PAM sequence: TTA
cagttttctgtaaaggaaaa

SEQ ID NO: 300766 - DNA, 20 bp, Artificial Sequence
  Description of Artificial Sequence: Synthetic oligonucleotide
  Target: ATXN1; (+) strand; PAM type: YTN; PAM sequence: TTT
tctgtaaaggaaaatgaaag

SEQ ID NO: 300767 - DNA, 20 bp, Artificial Sequence
  Description of Artificial Sequence: Synthetic oligonucleotide
  Target: ATXN1; (+) strand; PAM type: YTN; PAM sequence: TTT
ctgtaaaggaaaatgaaaga

SEQ ID NO: 300768 - DNA, 20 bp, Artificial Sequence
  Description of Artificial Sequence: Synthetic oligonucleotide
  Target: ATXN1; (+) strand; PAM type: YTN; PAM sequence: TTC
tgtaaaggaaaatgaaagaa

SEQ ID NO: 300769 - DNA, 20 bp, Artificial Sequence
  Description of Artificial Sequence: Synthetic oligonucleotide
  Target: ATXN1; (+) strand; PAM type: YTN; PAM sequence: CTG
taaaggaaaatgaaagaaga

SEQ ID NO: 300770 - DNA, 20 bp, Artificial Sequence
  Description of Artificial Sequence: Synthetic oligonucleotide
  Target: ATXN1; (+) strand; PAM type: YTN; PAM sequence: CTG
tttaaaatttaaaaccacat

SEQ ID NO: 300771 - DNA, 20 bp, Artificial Sequence
  Description of Artificial Sequence: Synthetic oligonucleotide
  Target: ATXN1; (+) strand; PAM type: YTN; PAM sequence: TTT
aaaatttaaaaccacattaa

SEQ ID NO: 300772 - DNA, 20 bp, Artificial Sequence
  Description of Artificial Sequence: Synthetic oligonucleotide
  Target: ATXN1; (+) strand; PAM type: YTN; PAM sequence: TTA
aaatttaaaaccacattaaa

SEQ ID NO: 300773 - DNA, 20 bp, Artificial Sequence
  Description of Artificial Sequence: Synthetic oligonucleotide
  Target: ATXN1; (+) strand; PAM type: YTN; PAM sequence: TTT
aaaaccacattaaaagattg

SEQ ID NO: 300774 - DNA, 20 bp, Artificial Sequence
  Description of Artificial Sequence: Synthetic oligonucleotide
  Target: ATXN1; (+) strand; PAM type: YTN; PAM sequence: TTA
aaaccacattaaaagattga

SEQ ID NO: 300775 - DNA, 20 bp, Artificial Sequence
  Description of Artificial Sequence: Synthetic oligonucleotide
  Target: ATXN1; (+) strand; PAM type: YTN; PAM sequence: TTA
aaagattgagagttttttgt

SEQ ID NO: 300776 - DNA, 20 bp, Artificial Sequence
  Description of Artificial Sequence: Synthetic oligonucleotide
  Target: ATXN1; (+) strand; PAM type: YTN; PAM sequence: TTG
agagttttttgtatttataa

SEQ ID NO: 300777 - DNA, 20 bp, Artificial Sequence
  Description of Artificial Sequence: Synthetic oligonucleotide
  Target: ATXN1; (+) strand; PAM type: YTN; PAM sequence: TTT
tttgtatttataaaaagctg

SEQ ID NO: 300778 - DNA, 20 bp, Artificial Sequence
  Description of Artificial Sequence: Synthetic oligonucleotide
  Target: ATXN1; (+) strand; PAM type: YTN; PAM sequence: TTT
ttgtatttataaaaagctga

SEQ ID NO: 300779 - DNA, 20 bp, Artificial Sequence
  Description of Artificial Sequence: Synthetic oligonucleotide
  Target: ATXN1; (+) strand; PAM type: YTN; PAM sequence: TTT
tgtatttataaaaagctgag

SEQ ID NO: 300780 - DNA, 20 bp, Artificial Sequence
  Description of Artificial Sequence: Synthetic oligonucleotide
  Target: ATXN1; (+) strand; PAM type: YTN; PAM sequence: TTT
gtatttataaaaagctgagg

SEQ ID NO: 300781 - DNA, 20 bp, Artificial Sequence
  Description of Artificial Sequence: Synthetic oligonucleotide
  Target: ATXN1; (+) strand; PAM type: YTN; PAM sequence: TTG
tatttataaaaagctgaggt

SEQ ID NO: 300782 - DNA, 20 bp, Artificial Sequence
  Description of Artificial Sequence: Synthetic oligonucleotide
  Target: ATXN1; (+) strand; PAM type: YTN; PAM sequence: TTT
ataaaaagctgaggtatgtt

SEQ ID NO: 300783 - DNA, 20 bp, Artificial Sequence
  Description of Artificial Sequence: Synthetic oligonucleotide
  Target: ATXN1; (+) strand; PAM type: YTN; PAM sequence: TTA
taaaaagctgaggtatgtta

SEQ ID NO: 300784 - DNA, 20 bp, Artificial Sequence
  Description of Artificial Sequence: Synthetic oligonucleotide
  Target: ATXN1; (+) strand; PAM type: YTN; PAM sequence: CTG
aggtatgttaaaaatggaaa

SEQ ID NO: 300785 - DNA, 20 bp, Artificial Sequence
  Description of Artificial Sequence: Synthetic oligonucleotide
  Target: ATXN1; (+) strand; PAM type: YTN; PAM sequence: TTA
aaaatggaaagcacctatta

SEQ ID NO: 300786 - DNA, 20 bp, Artificial Sequence
  Description of Artificial Sequence: Synthetic oligonucleotide
  Target: ATXN1; (+) strand; PAM type: YTN; PAM sequence: CTA
ttaagctgttactgtcagtt

SEQ ID NO: 300787 - DNA, 20 bp, Artificial Sequence
  Description of Artificial Sequence: Synthetic oligonucleotide
  Target: ATXN1; (+) strand; PAM type: YTN; PAM sequence: TTA
agctgttactgtcagtttca

SEQ ID NO: 300788 - DNA, 20 bp, Artificial Sequence
  Description of Artificial Sequence: Synthetic oligonucleotide
  Target: ATXN1; (+) strand; PAM type: YTN; PAM sequence: CTG
ttactgtcagtttcacctgt

SEQ ID NO: 300789 - DNA, 20 bp, Artificial Sequence
  Description of Artificial Sequence: Synthetic oligonucleotide
  Target: ATXN1; (+) strand; PAM type: YTN; PAM sequence: TTA
ctgtcagtttcacctgttaa

SEQ ID NO: 300790 - DNA, 20 bp, Artificial Sequence
  Description of Artificial Sequence: Synthetic oligonucleotide
  Target: ATXN1; (+) strand; PAM type: YTN; PAM sequence: CTG
tcagtttcacctgttaagta

SEQ ID NO: 300791 - DNA, 20 bp, Artificial Sequence
  Description of Artificial Sequence: Synthetic oligonucleotide
  Target: ATXN1; (+) strand; PAM type: YTN; PAM sequence: TTT
cacctgttaagtaggtacta

SEQ ID NO: 300792 - DNA, 20 bp, Artificial Sequence
  Description of Artificial Sequence: Synthetic oligonucleotide
  Target: ATXN1; (+) strand; PAM type: YTN; PAM sequence: TTC
acctgttaagtaggtactat

SEQ ID NO: 300793 - DNA, 20 bp, Artificial Sequence
  Description of Artificial Sequence: Synthetic oligonucleotide
  Target: ATXN1; (+) strand; PAM type: YTN; PAM sequence: CTG
ttaagtaggtactattagtt

SEQ ID NO: 300794 - DNA, 20 bp, Artificial Sequence
  Description of Artificial Sequence: Synthetic oligonucleotide
  Target: ATXN1; (+) strand; PAM type: YTN; PAM sequence: TTA
agtaggtactattagttaag

SEQ ID NO: 300795 - DNA, 20 bp, Artificial Sequence
  Description of Artificial Sequence: Synthetic oligonucleotide
  Target: ATXN1; (+) strand; PAM type: YTN; PAM sequence: CTA
ttagttaagccagcatagtt

SEQ ID NO: 300796 - DNA, 20 bp, Artificial Sequence
  Description of Artificial Sequence: Synthetic oligonucleotide
  Target: ATXN1; (+) strand; PAM type: YTN; PAM sequence: TTA
gttaagccagcatagttcct

SEQ ID NO: 300797 - DNA, 20 bp, Artificial Sequence
  Description of Artificial Sequence: Synthetic oligonucleotide
  Target: ATXN1; (+) strand; PAM type: YTN; PAM sequence: TTA
agccagcatagttcctgagt

SEQ ID NO: 300798 - DNA, 20 bp, Artificial Sequence
  Description of Artificial Sequence: Synthetic oligonucleotide
  Target: ATXN1; (+) strand; PAM type: YTN; PAM sequence: TTC
ctgagttgcaaagcatatac

SEQ ID NO: 300799 - DNA, 20 bp, Artificial Sequence
  Description of Artificial Sequence: Synthetic oligonucleotide
  Target: ATXN1; (+) strand; PAM type: YTN; PAM sequence: CTG
agttgcaaagcatatacagg

SEQ ID NO: 300800 - DNA, 20 bp, Artificial Sequence
  Description of Artificial Sequence: Synthetic oligonucleotide
  Target: ATXN1; (+) strand; PAM type: YTN; PAM sequence: TTG
caaagcatatacaggctgaa

SEQ ID NO: 300801 - DNA, 20 bp, Artificial Sequence
  Description of Artificial Sequence: Synthetic oligonucleotide
  Target: ATXN1; (+) strand; PAM type: YTN; PAM sequence: CTG
aagtacaatgtcaagaaaac

SEQ ID NO: 300802 - DNA, 20 bp, Artificial Sequence
  Description of Artificial Sequence: Synthetic oligonucleotide
  Target: ATXN1; (+) strand; PAM type: YTN; PAM sequence: TTA
aagggtggtaaataaatagc

SEQ ID NO: 300803 - DNA, 20 bp, Artificial Sequence
  Description of Artificial Sequence: Synthetic oligonucleotide
  Target: ATXN1; (+) strand; PAM type: YTN; PAM sequence: CTG
agaagatactctgaacagat

SEQ ID NO: 300804 - DNA, 20 bp, Artificial Sequence
  Description of Artificial Sequence: Synthetic oligonucleotide
  Target: ATXN1; (+) strand; PAM type: YTN; PAM sequence: CTC
tgaacagataaataagaaaa

SEQ ID NO: 300805 - DNA, 20 bp, Artificial Sequence
  Description of Artificial Sequence: Synthetic oligonucleotide
  Target: ATXN1; (+) strand; PAM type: YTN; PAM sequence: CTG
aacagataaataagaaaaaa

SEQ ID NO: 300806 - DNA, 20 bp, Artificial Sequence
  Description of Artificial Sequence: Synthetic oligonucleotide
  Target: ATXN1; (+) strand; PAM type: YTN; PAM sequence: TTG
aaataaatggaagctctagg

SEQ ID NO: 300807 - DNA, 20 bp, Artificial Sequence
  Description of Artificial Sequence: Synthetic oligonucleotide
  Target: ATXN1; (+) strand; PAM type: YTN; PAM sequence: CTC
taggcagtgtgtggacagac

SEQ ID NO: 300808 - DNA, 20 bp, Artificial Sequence
  Description of Artificial Sequence: Synthetic oligonucleotide
  Target: ATXN1; (+) strand; PAM type: YTN; PAM sequence: CTA
ggcagtgtgtggacagacag

SEQ ID NO: 300809 - DNA, 20 bp, Artificial Sequence
  Description of Artificial Sequence: Synthetic oligonucleotide
  Target: ATXN1; (+) strand; PAM type: YTN; PAM sequence: CTG
tttatgccttggcctgaatg

SEQ ID NO: 300810 - DNA, 20 bp, Artificial Sequence
  Description of Artificial Sequence: Synthetic oligonucleotide
  Target: ATXN1; (+) strand; PAM type: YTN; PAM sequence: TTT
atgccttggcctgaatgtct

SEQ ID NO: 300811 - DNA, 20 bp, Artificial Sequence
  Description of Artificial Sequence: Synthetic oligonucleotide
  Target: ATXN1; (+) strand; PAM type: YTN; PAM sequence: TTA
tgccttggcctgaatgtctg

SEQ ID NO: 300812 - DNA, 20 bp, Artificial Sequence
  Description of Artificial Sequence: Synthetic oligonucleotide
  Target: ATXN1; (+) strand; PAM type: YTN; PAM sequence: CTT
ggcctgaatgtctgtgtgcc

SEQ ID NO: 300813 - DNA, 20 bp, Artificial Sequence
  Description of Artificial Sequence: Synthetic oligonucleotide
  Target: ATXN1; (+) strand; PAM type: YTN; PAM sequence: TTG
gcctgaatgtctgtgtgcct

SEQ ID NO: 300814 - DNA, 20 bp, Artificial Sequence
  Description of Artificial Sequence: Synthetic oligonucleotide
  Target: ATXN1; (+) strand; PAM type: YTN; PAM sequence: CTG
aatgtctgtgtgcctccaaa

SEQ ID NO: 300815 - DNA, 20 bp, Artificial Sequence
  Description of Artificial Sequence: Synthetic oligonucleotide
  Target: ATXN1; (+) strand; PAM type: YTN; PAM sequence: CTG
tgtgcctccaaaattcacat

SEQ ID NO: 300816 - DNA, 20 bp, Artificial Sequence
  Description of Artificial Sequence: Synthetic oligonucleotide
  Target: ATXN1; (+) strand; PAM type: YTN; PAM sequence: CTC
caaaattcacatgtcgaatc

SEQ ID NO: 300817 - DNA, 20 bp, Artificial Sequence
  Description of Artificial Sequence: Synthetic oligonucleotide
  Target: ATXN1; (+) strand; PAM type: YTN; PAM sequence: TTC
acatgtcgaatcctaactcc

SEQ ID NO: 300818 - DNA, 20 bp, Artificial Sequence
  Description of Artificial Sequence: Synthetic oligonucleotide
  Target: ATXN1; (+) strand; PAM type: YTN; PAM sequence: CTA
actccccacgtgatagtatt

SEQ ID NO: 300819 - DNA, 20 bp, Artificial Sequence
  Description of Artificial Sequence: Synthetic oligonucleotide
  Target: ATXN1; (+) strand; PAM type: YTN; PAM sequence: CTC
cccacgtgatagtattaggg

SEQ ID NO: 300820 - DNA, 20 bp, Artificial Sequence
  Description of Artificial Sequence: Synthetic oligonucleotide
  Target: ATXN1; (+) strand; PAM type: YTN; PAM sequence: TTA
gggagtggagcccttgggag

SEQ ID NO: 300821 - DNA, 20 bp, Artificial Sequence
  Description of Artificial Sequence: Synthetic oligonucleotide
  Target: ATXN1; (+) strand; PAM type: YTN; PAM sequence: CTT
gggaggtgccctcttgaatg

SEQ ID NO: 300822 - DNA, 20 bp, Artificial Sequence
  Description of Artificial Sequence: Synthetic oligonucleotide
  Target: ATXN1; (+) strand; PAM type: YTN; PAM sequence: TTG
ggaggtgccctcttgaatgg

SEQ ID NO: 300823 - DNA, 20 bp, Artificial Sequence
  Description of Artificial Sequence: Synthetic oligonucleotide
  Target: ATXN1; (+) strand; PAM type: YTN; PAM sequence: CTC
ttgaatggaattagcacctt

SEQ ID NO: 300824 - DNA, 20 bp, Artificial Sequence
  Description of Artificial Sequence: Synthetic oligonucleotide
  Target: ATXN1; (+) strand; PAM type: YTN; PAM sequence: CTT
gaatggaattagcaccttta

SEQ ID NO: 300825 - DNA, 20 bp, Artificial Sequence
  Description of Artificial Sequence: Synthetic oligonucleotide
  Target: ATXN1; (+) strand; PAM type: YTN; PAM sequence: TTG
aatggaattagcacctttat

SEQ ID NO: 300826 - DNA, 20 bp, Artificial Sequence
  Description of Artificial Sequence: Synthetic oligonucleotide
  Target: ATXN1; (+) strand; PAM type: YTN; PAM sequence: TTA
gcacctttatcaaagaactc

SEQ ID NO: 300827 - DNA, 20 bp, Artificial Sequence
  Description of Artificial Sequence: Synthetic oligonucleotide
  Target: ATXN1; (+) strand; PAM type: YTN; PAM sequence: CTT
tatcaaagaactcccccagg

SEQ ID NO: 300828 - DNA, 20 bp, Artificial Sequence
  Description of Artificial Sequence: Synthetic oligonucleotide
  Target: ATXN1; (+) strand; PAM type: YTN; PAM sequence: TTT
atcaaagaactcccccagga

SEQ ID NO: 300829 - DNA, 20 bp, Artificial Sequence
  Description of Artificial Sequence: Synthetic oligonucleotide
  Target: ATXN1; (+) strand; PAM type: YTN; PAM sequence: TTA
tcaaagaactcccccaggaa

SEQ ID NO: 300830 - DNA, 20 bp, Artificial Sequence
  Description of Artificial Sequence: Synthetic oligonucleotide
  Target: ATXN1; (+) strand; PAM type: YTN; PAM sequence: CTC
ccccaggaactgctttgcct

SEQ ID NO: 300831 - DNA, 20 bp, Artificial Sequence
  Description of Artificial Sequence: Synthetic oligonucleotide
  Target: ATXN1; (+) strand; PAM type: YTN; PAM sequence: CTG
ctttgcctcttccaccatgt

SEQ ID NO: 300832 - DNA, 20 bp, Artificial Sequence
  Description of Artificial Sequence: Synthetic oligonucleotide
  Target: ATXN1; (+) strand; PAM type: YTN; PAM sequence: CTT
tgcctcttccaccatgtgag

SEQ ID NO: 300833 - DNA, 20 bp, Artificial Sequence
  Description of Artificial Sequence: Synthetic oligonucleotide
  Target: ATXN1; (+) strand; PAM type: YTN; PAM sequence: TTT
gcctcttccaccatgtgagg

SEQ ID NO: 300834 - DNA, 20 bp, Artificial Sequence
  Description of Artificial Sequence: Synthetic oligonucleotide
  Target: ATXN1; (+) strand; PAM type: YTN; PAM sequence: TTG
cctcttccaccatgtgagga

SEQ ID NO: 300835 - DNA, 20 bp, Artificial Sequence
  Description of Artificial Sequence: Synthetic oligonucleotide
  Target: ATXN1; (+) strand; PAM type: YTN; PAM sequence: CTC
ttccaccatgtgaggataca

SEQ ID NO: 300836 - DNA, 20 bp, Artificial Sequence
  Description of Artificial Sequence: Synthetic oligonucleotide
  Target: ATXN1; (+) strand; PAM type: YTN; PAM sequence: CTT
ccaccatgtgaggatacaca

SEQ ID NO: 300837 - DNA, 20 bp, Artificial Sequence
  Description of Artificial Sequence: Synthetic oligonucleotide
  Target: ATXN1; (+) strand; PAM type: YTN; PAM sequence: TTC
caccatgtgaggatacacag

SEQ ID NO: 300838 - DNA, 20 bp, Artificial Sequence
  Description of Artificial Sequence: Synthetic oligonucleotide
  Target: ATXN1; (+) strand; PAM type: YTN; PAM sequence: CTG
tgagccttagaacaagcctt

SEQ ID NO: 300839 - DNA, 20 bp, Artificial Sequence
  Description of Artificial Sequence: Synthetic oligonucleotide
  Target: ATXN1; (+) strand; PAM type: YTN; PAM sequence: CTT
agaacaagccttagaatagg

SEQ ID NO: 300840 - DNA, 20 bp, Artificial Sequence
  Description of Artificial Sequence: Synthetic oligonucleotide
  Target: ATXN1; (+) strand; PAM type: YTN; PAM sequence: TTA
gaacaagccttagaataggc

SEQ ID NO: 300841 - DNA, 20 bp, Artificial Sequence
  Description of Artificial Sequence: Synthetic oligonucleotide
  Target: ATXN1; (+) strand; PAM type: YTN; PAM sequence: CTT
agaataggccgggtgtggtg

SEQ ID NO: 300842 - DNA, 20 bp, Artificial Sequence
  Description of Artificial Sequence: Synthetic oligonucleotide
  Target: ATXN1; (+) strand; PAM type: YTN; PAM sequence: TTA
gaataggccgggtgtggtgg

SEQ ID NO: 300843 - DNA, 20 bp, Artificial Sequence
  Description of Artificial Sequence: Synthetic oligonucleotide
  Target: ATXN1; (+) strand; PAM type: YTN; PAM sequence: CTC
aagcctgtaatcccagcact

SEQ ID NO: 300844 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 300845 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggcag

SEQ ID NO: 300846 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggcaga

SEQ ID NO: 300847 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggcagat

SEQ ID NO: 300848 - DNA, 20 bp, Artificial Sequence
  Description of Artificial Sequence: Synthetic oligonucleotide
  Target: ATXN1; (+) strand; PAM type: YTN; PAM sequence: CTG
acatcaggagttcgagacca

SEQ ID NO: 300849 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctggccaatat

SEQ ID NO: 300850 - DNA, 20 bp, Artificial Sequence
  Description of Artificial Sequence: Synthetic oligonucleotide
  Target: ATXN1; (+) strand; PAM type: YTN; PAM sequence: CTG
gccaatatggtgaaacctca

SEQ ID NO: 300851 - DNA, 20 bp, Artificial Sequence
  Description of Artificial Sequence: Synthetic oligonucleotide
  Target: ATXN1; (+) strand; PAM type: YTN; PAM sequence: CTC
atctctactaaaaatacacc

SEQ ID NO: 300852 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaccgggcg

SEQ ID NO: 300853 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaccgggcgtg

SEQ ID NO: 300854 - DNA, 20 bp, Artificial Sequence
  Description of Artificial Sequence: Synthetic oligonucleotide
  Target: ATXN1; (+) strand; PAM type: YTN; PAM sequence: CTA
aaaatacaccgggcgtggtg

SEQ ID NO: 300855 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcaggag

SEQ ID NO: 300856 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgagacagta

SEQ ID NO: 300857 - DNA, 20 bp, Artificial Sequence
  Description of Artificial Sequence: Synthetic oligonucleotide
  Target: ATXN1; (+) strand; PAM type: YTN; PAM sequence: CTC
aggaggctgagacagtagaa

SEQ ID NO: 300858 - DNA, 20 bp, Artificial Sequence
  Description of Artificial Sequence: Synthetic oligonucleotide
  Target: ATXN1; (+) strand; PAM type: YTN; PAM sequence: CTG
agacagtagaattgcttgaa

SEQ ID NO: 300859 - DNA, 20 bp, Artificial Sequence
  Description of Artificial Sequence: Synthetic oligonucleotide
  Target: ATXN1; (+) strand; PAM type: YTN; PAM sequence: TTG
cttgaacctgggaggcggag

SEQ ID NO: 300860 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcggaggtt

SEQ ID NO: 300861 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcggaggttg

SEQ ID NO: 300862 - DNA, 20 bp, Artificial Sequence
  Description of Artificial Sequence: Synthetic oligonucleotide
  Target: ATXN1; (+) strand; PAM type: YTN; PAM sequence: CTG
ggaggcggaggttgcagtga

SEQ ID NO: 300863 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcatgcc

SEQ ID NO: 300864 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgactg

SEQ ID NO: 300865 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgactgagcga

SEQ ID NO: 300866 - DNA, 20 bp, Artificial Sequence
  Description of Artificial Sequence: Synthetic oligonucleotide
  Target: ATXN1; (+) strand; PAM type: YTN; PAM sequence: CTG
ggcgactgagcgagactctg

SEQ ID NO: 300867 - DNA, 20 bp, Artificial Sequence
  Description of Artificial Sequence: Synthetic oligonucleotide
  Target: ATXN1; (+) strand; PAM type: YTN; PAM sequence: CTG
agcgagactctgcaaatatg

SEQ ID NO: 300868 - DNA, 20 bp, Artificial Sequence
  Description of Artificial Sequence: Synthetic oligonucleotide
  Target: ATXN1; (+) strand; PAM type: YTN; PAM sequence: CTC
tgcaaatatgtactttatat

SEQ ID NO: 300869 - DNA, 20 bp, Artificial Sequence
  Description of Artificial Sequence: Synthetic oligonucleotide
  Target: ATXN1; (+) strand; PAM type: YTN; PAM sequence: CTG
caaatatgtactttatatga

SEQ ID NO: 300870 - DNA, 20 bp, Artificial Sequence
  Description of Artificial Sequence: Synthetic oligonucleotide
  Target: ATXN1; (+) strand; PAM type: YTN; PAM sequence: CTT
tatatgattaatctatttgt

SEQ ID NO: 300871 - DNA, 20 bp, Artificial Sequence
  Description of Artificial Sequence: Synthetic oligonucleotide
  Target: ATXN1; (+) strand; PAM type: YTN; PAM sequence: TTT
atatgattaatctatttgta

SEQ ID NO: 300872 - DNA, 20 bp, Artificial Sequence
  Description of Artificial Sequence: Synthetic oligonucleotide
  Target: ATXN1; (+) strand; PAM type: YTN; PAM sequence: TTA
tatgattaatctatttgtaa

SEQ ID NO: 300873 - DNA, 20 bp, Artificial Sequence
  Description of Artificial Sequence: Synthetic oligonucleotide
  Target: ATXN1; (+) strand; PAM type: YTN; PAM sequence: TTA
atctatttgtaaccattgaa

SEQ ID NO: 300874 - DNA, 20 bp, Artificial Sequence
  Description of Artificial Sequence: Synthetic oligonucleotide
  Target: ATXN1; (+) strand; PAM type: YTN; PAM sequence: CTA
tttgtaaccattgaagtaaa

SEQ ID NO: 300875 - DNA, 20 bp, Artificial Sequence
  Description of Artificial Sequence: Synthetic oligonucleotide
  Target: ATXN1; (+) strand; PAM type: YTN; PAM sequence: TTT
gtaaccattgaagtaaacat

SEQ ID NO: 300876 - DNA, 20 bp, Artificial Sequence
  Description of Artificial Sequence: Synthetic oligonucleotide
  Target: ATXN1; (+) strand; PAM type: YTN; PAM sequence: TTG
taaccattgaagtaaacatt

SEQ ID NO: 300877 - DNA, 20 bp, Artificial Sequence
  Description of Artificial Sequence: Synthetic oligonucleotide
  Target: ATXN1; (+) strand; PAM type: YTN; PAM sequence: TTG
aagtaaacatttttctttgt

SEQ ID NO: 300878 - DNA, 20 bp, Artificial Sequence
  Description of Artificial Sequence: Synthetic oligonucleotide
  Target: ATXN1; (+) strand; PAM type: YTN; PAM sequence: TTT
ttctttgtgcttttaaattc

SEQ ID NO: 300879 - DNA, 20 bp, Artificial Sequence
  Description of Artificial Sequence: Synthetic oligonucleotide
  Target: ATXN1; (+) strand; PAM type: YTN; PAM sequence: TTT
tctttgtgcttttaaattca

SEQ ID NO: 300880 - DNA, 20 bp, Artificial Sequence
  Description of Artificial Sequence: Synthetic oligonucleotide
  Target: ATXN1; (+) strand; PAM type: YTN; PAM sequence: TTT
ctttgtgcttttaaattcaa

SEQ ID NO: 300881 - DNA, 20 bp, Artificial Sequence
  Description of Artificial Sequence: Synthetic oligonucleotide
  Target: ATXN1; (+) strand; PAM type: YTN; PAM sequence: TTC
tttgtgcttttaaattcaaa

SEQ ID NO: 300882 - DNA, 20 bp, Artificial Sequence
  Description of Artificial Sequence: Synthetic oligonucleotide
  Target: ATXN1; (+) strand; PAM type: YTN; PAM sequence: CTT
tgtgcttttaaattcaaacc

SEQ ID NO: 300883 - DNA, 20 bp, Artificial Sequence
  Description of Artificial Sequence: Synthetic oligonucleotide
  Target: ATXN1; (+) strand; PAM type: YTN; PAM sequence: TTT
gtgcttttaaattcaaacct

SEQ ID NO: 300884 - DNA, 20 bp, Artificial Sequence
  Description of Artificial Sequence: Synthetic oligonucleotide
  Target: ATXN1; (+) strand; PAM type: YTN; PAM sequence: TTG
tgcttttaaattcaaacctc

SEQ ID NO: 300885 - DNA, 20 bp, Artificial Sequence
  Description of Artificial Sequence: Synthetic oligonucleotide
  Target: ATXN1; (+) strand; PAM type: YTN; PAM sequence: CTT
ttaaattcaaacctctacct

SEQ ID NO: 300886 - DNA, 20 bp, Artificial Sequence
  Description of Artificial Sequence: Synthetic oligonucleotide
  Target: ATXN1; (+) strand; PAM type: YTN; PAM sequence: TTT
taaattcaaacctctacctt

SEQ ID NO: 300887 - DNA, 20 bp, Artificial Sequence
  Description of Artificial Sequence: Synthetic oligonucleotide
  Target: ATXN1; (+) strand; PAM type: YTN; PAM sequence: TTT
aaattcaaacctctacctta

SEQ ID NO: 300888 - DNA, 20 bp, Artificial Sequence
  Description of Artificial Sequence: Synthetic oligonucleotide
  Target: ATXN1; (+) strand; PAM type: YTN; PAM sequence: TTA
aattcaaacctctaccttag

SEQ ID NO: 300889 - DNA, 20 bp, Artificial Sequence
  Description of Artificial Sequence: Synthetic oligonucleotide
  Target: ATXN1; (+) strand; PAM type: YTN; PAM sequence: TTC
aaacctctaccttagcagcc

SEQ ID NO: 300890 - DNA, 20 bp, Artificial Sequence
  Description of Artificial Sequence: Synthetic oligonucleotide
  Target: ATXN1; (+) strand; PAM type: YTN; PAM sequence: CTC
taccttagcagccatatcac

SEQ ID NO: 300891 - DNA, 20 bp, Artificial Sequence
  Description of Artificial Sequence: Synthetic oligonucleotide
  Target: ATXN1; (+) strand; PAM type: YTN; PAM sequence: CTA
ccttagcagccatatcacag

SEQ ID NO: 300892 - DNA, 20 bp, Artificial Sequence
  Description of Artificial Sequence: Synthetic oligonucleotide
  Target: ATXN1; (+) strand; PAM type: YTN; PAM sequence: CTT
agcagccatatcacagtcac

SEQ ID NO: 300893 - DNA, 20 bp, Artificial Sequence
  Description of Artificial Sequence: Synthetic oligonucleotide
  Target: ATXN1; (+) strand; PAM type: YTN; PAM sequence: TTA
gcagccatatcacagtcaca

SEQ ID NO: 300894 - DNA, 20 bp, Artificial Sequence
  Description of Artificial Sequence: Synthetic oligonucleotide
  Target: ATXN1; (+) strand; PAM type: YTN; PAM sequence: TTA
actatatggcaagtaatctg

SEQ ID NO: 300895 - DNA, 20 bp, Artificial Sequence
  Description of Artificial Sequence: Synthetic oligonucleotide
  Target: ATXN1; (+) strand; PAM type: YTN; PAM sequence: CTA
tatggcaagtaatctgtatg

SEQ ID NO: 300896 - DNA, 20 bp, Artificial Sequence
  Description of Artificial Sequence: Synthetic oligonucleotide
  Target: ATXN1; (+) strand; PAM type: YTN; PAM sequence: CTG
tatgattactttgggttctc

SEQ ID NO: 300897 - DNA, 20 bp, Artificial Sequence
  Description of Artificial Sequence: Synthetic oligonucleotide
  Target: ATXN1; (+) strand; PAM type: YTN; PAM sequence: TTA
ctttgggttctcagatgact

SEQ ID NO: 300898 - DNA, 20 bp, Artificial Sequence
  Description of Artificial Sequence: Synthetic oligonucleotide
  Target: ATXN1; (+) strand; PAM type: YTN; PAM sequence: CTT
tgggttctcagatgacttgc

SEQ ID NO: 300899 - DNA, 20 bp, Artificial Sequence
  Description of Artificial Sequence: Synthetic oligonucleotide
  Target: ATXN1; (+) strand; PAM type: YTN; PAM sequence: TTT
gggttctcagatgacttgct

SEQ ID NO: 300900 - DNA, 20 bp, Artificial Sequence
  Description of Artificial Sequence: Synthetic oligonucleotide
  Target: ATXN1; (+) strand; PAM type: YTN; PAM sequence: TTG
ggttctcagatgacttgcta

SEQ ID NO: 300901 - DNA, 20 bp, Artificial Sequence
  Description of Artificial Sequence: Synthetic oligonucleotide
  Target: ATXN1; (+) strand; PAM type: YTN; PAM sequence: TTC
tcagatgacttgctatgtat

SEQ ID NO: 300902 - DNA, 20 bp, Artificial Sequence
  Description of Artificial Sequence: Synthetic oligonucleotide
  Target: ATXN1; (+) strand; PAM type: YTN; PAM sequence: CTC
agatgacttgctatgtattt

SEQ ID NO: 300903 - DNA, 20 bp, Artificial Sequence
  Description of Artificial Sequence: Synthetic oligonucleotide
  Target: ATXN1; (+) strand; PAM type: YTN; PAM sequence: CTT
gctatgtatttaatgaagta

SEQ ID NO: 300904 - DNA, 20 bp, Artificial Sequence
  Description of Artificial Sequence: Synthetic oligonucleotide
  Target: ATXN1; (+) strand; PAM type: YTN; PAM sequence: TTG
ctatgtatttaatgaagtaa

SEQ ID NO: 300905 - DNA, 20 bp, Artificial Sequence
  Description of Artificial Sequence: Synthetic oligonucleotide
  Target: ATXN1; (+) strand; PAM type: YTN; PAM sequence: CTA
tgtatttaatgaagtaaaat

SEQ ID NO: 300906 - DNA, 20 bp, Artificial Sequence
  Description of Artificial Sequence: Synthetic oligonucleotide
  Target: ATXN1; (+) strand; PAM type: YTN; PAM sequence: TTT
aatgaagtaaaattgtaagt

SEQ ID NO: 300907 - DNA, 20 bp, Artificial Sequence
  Description of Artificial Sequence: Synthetic oligonucleotide
  Target: ATXN1; (+) strand; PAM type: YTN; PAM sequence: TTA
atgaagtaaaattgtaagtc

SEQ ID NO: 300908 - DNA, 20 bp, Artificial Sequence
  Description of Artificial Sequence: Synthetic oligonucleotide
  Target: ATXN1; (+) strand; PAM type: YTN; PAM sequence: TTG
taagtcaagtcagatatagg

SEQ ID NO: 300909 - DNA, 20 bp, Artificial Sequence
  Description of Artificial Sequence: Synthetic oligonucleotide
  Target: ATXN1; (+) strand; PAM type: YTN; PAM sequence: TTA
acaaatgtaatcaaaagatt

SEQ ID NO: 300910 - DNA, 20 bp, Artificial Sequence
  Description of Artificial Sequence: Synthetic oligonucleotide
  Target: ATXN1; (+) strand; PAM type: YTN; PAM sequence: TTT
gtctattttaaagactcaag

SEQ ID NO: 300911 - DNA, 20 bp, Artificial Sequence
  Description of Artificial Sequence: Synthetic oligonucleotide
  Target: ATXN1; (+) strand; PAM type: YTN; PAM sequence: TTG
tctattttaaagactcaaga

SEQ ID NO: 300912 - DNA, 20 bp, Artificial Sequence
  Description of Artificial Sequence: Synthetic oligonucleotide
  Target: ATXN1; (+) strand; PAM type: YTN; PAM sequence: CTA
ttttaaagactcaagaaaga

SEQ ID NO: 300913 - DNA, 20 bp, Artificial Sequence
  Description of Artificial Sequence: Synthetic oligonucleotide
  Target: ATXN1; (+) strand; PAM type: YTN; PAM sequence: TTT
taaagactcaagaaagacaa

SEQ ID NO: 300914 - DNA, 20 bp, Artificial Sequence
  Description of Artificial Sequence: Synthetic oligonucleotide
  Target: ATXN1; (+) strand; PAM type: YTN; PAM sequence: TTT
aaagactcaagaaagacaat

SEQ ID NO: 300915 - DNA, 20 bp, Artificial Sequence
  Description of Artificial Sequence: Synthetic oligonucleotide
  Target: ATXN1; (+) strand; PAM type: YTN; PAM sequence: TTA
aagactcaagaaagacaatt

SEQ ID NO: 300916 - DNA, 20 bp, Artificial Sequence
  Description of Artificial Sequence: Synthetic oligonucleotide
  Target: ATXN1; (+) strand; PAM type: YTN; PAM sequence: CTC
aagaaagacaattataccca

SEQ ID NO: 300917 - DNA, 20 bp, Artificial Sequence
  Description of Artificial Sequence: Synthetic oligonucleotide
  Target: ATXN1; (+) strand; PAM type: YTN; PAM sequence: TTA
tacccaattaacacacacat

SEQ ID NO: 300918 - DNA, 20 bp, Artificial Sequence
  Description of Artificial Sequence: Synthetic oligonucleotide
  Target: ATXN1; (+) strand; PAM type: YTN; PAM sequence: TTA
acacacacattcatatgaag

SEQ ID NO: 300919 - DNA, 20 bp, Artificial Sequence
  Description of Artificial Sequence: Synthetic oligonucleotide
  Target: ATXN1; (+) strand; PAM type: YTN; PAM sequence: TTC
atatgaagggtacaaatacc

SEQ ID NO: 300920 - DNA, 20 bp, Artificial Sequence
  Description of Artificial Sequence: Synthetic oligonucleotide
  Target: ATXN1; (+) strand; PAM type: YTN; PAM sequence: CTA
atttttggaaaacatttcat

SEQ ID NO: 300921 - DNA, 20 bp, Artificial Sequence
  Description of Artificial Sequence: Synthetic oligonucleotide
  Target: ATXN1; (+) strand; PAM type: YTN; PAM sequence: TTT
ttggaaaacatttcatataa

SEQ ID NO: 300922 - DNA, 20 bp, Artificial Sequence
  Description of Artificial Sequence: Synthetic oligonucleotide
  Target: ATXN1; (+) strand; PAM type: YTN; PAM sequence: TTT
tggaaaacatttcatataat

SEQ ID NO: 300923 - DNA, 20 bp, Artificial Sequence
  Description of Artificial Sequence: Synthetic oligonucleotide
  Target: ATXN1; (+) strand; PAM type: YTN; PAM sequence: TTT
ggaaaacatttcatataatt

SEQ ID NO: 300924 - DNA, 20 bp, Artificial Sequence
  Description of Artificial Sequence: Synthetic oligonucleotide
  Target: ATXN1; (+) strand; PAM type: YTN; PAM sequence: TTG
gaaaacatttcatataattt

SEQ ID NO: 300925 - DNA, 20 bp, Artificial Sequence
  Description of Artificial Sequence: Synthetic oligonucleotide
  Target: ATXN1; (+) strand; PAM type: YTN; PAM sequence: TTT
catataattttggccattgt

SEQ ID NO: 300926 - DNA, 20 bp, Artificial Sequence
  Description of Artificial Sequence: Synthetic oligonucleotide
  Target: ATXN1; (+) strand; PAM type: YTN; PAM sequence: TTC
atataattttggccattgta

SEQ ID NO: 300927 - DNA, 20 bp, Artificial Sequence
  Description of Artificial Sequence: Synthetic oligonucleotide
  Target: ATXN1; (+) strand; PAM type: YTN; PAM sequence: TTT
tggccattgtaaatatataa

SEQ ID NO: 300928 - DNA, 20 bp, Artificial Sequence
  Description of Artificial Sequence: Synthetic oligonucleotide
  Target: ATXN1; (+) strand; PAM type: YTN; PAM sequence: TTT
ggccattgtaaatatataaa

SEQ ID NO: 300929 - DNA, 20 bp, Artificial Sequence
  Description of Artificial Sequence: Synthetic oligonucleotide
  Target: ATXN1; (+) strand; PAM type: YTN; PAM sequence: TTG
gccattgtaaatatataaat

SEQ ID NO: 300930 - DNA, 20 bp, Artificial Sequence
  Description of Artificial Sequence: Synthetic oligonucleotide
  Target: ATXN1; (+) strand; PAM type: YTN; PAM sequence: TTG
taaatatataaataataata

SEQ ID NO: 300931 - DNA, 20 bp, Artificial Sequence
  Description of Artificial Sequence: Synthetic oligonucleotide
  Target: ATXN1; (+) strand; PAM type: YTN; PAM sequence: CTA
ccgccaccaccaacaacaaa

SEQ ID NO: 300932 - DNA, 20 bp, Artificial Sequence
  Description of Artificial Sequence: Synthetic oligonucleotide
  Target: ATXN1; (+) strand; PAM type: YTN; PAM sequence: CTT
tctaaaacatgaaggctaag

SEQ ID NO: 300933 - DNA, 20 bp, Artificial Sequence
  Description of Artificial Sequence: Synthetic oligonucleotide
  Target: ATXN1; (+) strand; PAM type: YTN; PAM sequence: TTT
ctaaaacatgaaggctaagg

SEQ ID NO: 300934 - DNA, 20 bp, Artificial Sequence
  Description of Artificial Sequence: Synthetic oligonucleotide
  Target: ATXN1; (+) strand; PAM type: YTN; PAM sequence: TTC
taaaacatgaaggctaagga

SEQ ID NO: 300935 - DNA, 20 bp, Artificial Sequence
  Description of Artificial Sequence: Synthetic oligonucleotide
  Target: ATXN1; (+) strand; PAM type: YTN; PAM sequence: CTA
aaacatgaaggctaaggaat

SEQ ID NO: 300936 - DNA, 20 bp, Artificial Sequence
  Description of Artificial Sequence: Synthetic oligonucleotide
  Target: ATXN1; (+) strand; PAM type: YTN; PAM sequence: CTA
aggaataagcagtgtgctgg

SEQ ID NO: 300937 - DNA, 20 bp, Artificial Sequence
  Description of Artificial Sequence: Synthetic oligonucleotide
  Target: ATXN1; (+) strand; PAM type: YTN; PAM sequence: CTG
ggcactttacctgtattcca

SEQ ID NO: 300938 - DNA, 20 bp, Artificial Sequence
  Description of Artificial Sequence: Synthetic oligonucleotide
  Target: ATXN1; (+) strand; PAM type: YTN; PAM sequence: CTT
tacctgtattccattgtgtt

SEQ ID NO: 300939 - DNA, 20 bp, Artificial Sequence
  Description of Artificial Sequence: Synthetic oligonucleotide
  Target: ATXN1; (+) strand; PAM type: YTN; PAM sequence: TTT
acctgtattccattgtgttc

SEQ ID NO: 300940 - DNA, 20 bp, Artificial Sequence
  Description of Artificial Sequence: Synthetic oligonucleotide
  Target: ATXN1; (+) strand; PAM type: YTN; PAM sequence: TTA
cctgtattccattgtgttct

SEQ ID NO: 300941 - DNA, 20 bp, Artificial Sequence
  Description of Artificial Sequence: Synthetic oligonucleotide
  Target: ATXN1; (+) strand; PAM type: YTN; PAM sequence: CTG
tattccattgtgttcttaca

SEQ ID NO: 300942 - DNA, 20 bp, Artificial Sequence
  Description of Artificial Sequence: Synthetic oligonucleotide
  Target: ATXN1; (+) strand; PAM type: YTN; PAM sequence: TTC
cattgtgttcttacaggtac

SEQ ID NO: 300943 - DNA, 20 bp, Artificial Sequence
  Description of Artificial Sequence: Synthetic oligonucleotide
  Target: ATXN1; (+) strand; PAM type: YTN; PAM sequence: TTG
tgttcttacaggtacattcc

SEQ ID NO: 300944 - DNA, 20 bp, Artificial Sequence
  Description of Artificial Sequence: Synthetic oligonucleotide
  Target: ATXN1; (+) strand; PAM type: YTN; PAM sequence: TTC
ttacaggtacattccatgtt

SEQ ID NO: 300945 - DNA, 20 bp, Artificial Sequence
  Description of Artificial Sequence: Synthetic oligonucleotide
  Target: ATXN1; (+) strand; PAM type: YTN; PAM sequence: CTT
acaggtacattccatgttct

SEQ ID NO: 300946 - DNA, 20 bp, Artificial Sequence
  Description of Artificial Sequence: Synthetic oligonucleotide
  Target: ATXN1; (+) strand; PAM type: YTN; PAM sequence: TTA
caggtacattccatgttcta

SEQ ID NO: 300947 - DNA, 20 bp, Artificial Sequence
  Description of Artificial Sequence: Synthetic oligonucleotide
  Target: ATXN1; (+) strand; PAM type: YTN; PAM sequence: TTC
catgttctatattttcactt

SEQ ID NO: 300948 - DNA, 20 bp, Artificial Sequence
  Description of Artificial Sequence: Synthetic oligonucleotide
  Target: ATXN1; (+) strand; PAM type: YTN; PAM sequence: TTC
tatattttcactttagagat

SEQ ID NO: 300949 - DNA, 20 bp, Artificial Sequence
  Description of Artificial Sequence: Synthetic oligonucleotide
  Target: ATXN1; (+) strand; PAM type: YTN; PAM sequence: CTA
tattttcactttagagatgt

SEQ ID NO: 300950 - DNA, 20 bp, Artificial Sequence
  Description of Artificial Sequence: Synthetic oligonucleotide
  Target: ATXN1; (+) strand; PAM type: YTN; PAM sequence: TTT
tcactttagagatgtggaaa

SEQ ID NO: 300951 - DNA, 20 bp, Artificial Sequence
  Description of Artificial Sequence: Synthetic oligonucleotide
  Target: ATXN1; (+) strand; PAM type: YTN; PAM sequence: TTT
cactttagagatgtggaaac

SEQ ID NO: 300952 - DNA, 20 bp, Artificial Sequence
  Description of Artificial Sequence: Synthetic oligonucleotide
  Target: ATXN1; (+) strand; PAM type: YTN; PAM sequence: TTC
actttagagatgtggaaact

SEQ ID NO: 300953 - DNA, 20 bp, Artificial Sequence
  Description of Artificial Sequence: Synthetic oligonucleotide
  Target: ATXN1; (+) strand; PAM type: YTN; PAM sequence: CTT
tagagatgtggaaactgaag

SEQ ID NO: 300954 - DNA, 20 bp, Artificial Sequence
  Description of Artificial Sequence: Synthetic oligonucleotide
  Target: ATXN1; (+) strand; PAM type: YTN; PAM sequence: TTT
agagatgtggaaactgaagc

SEQ ID NO: 300955 - DNA, 20 bp, Artificial Sequence
  Description of Artificial Sequence: Synthetic oligonucleotide
  Target: ATXN1; (+) strand; PAM type: YTN; PAM sequence: TTA
gagatgtggaaactgaagct

SEQ ID NO: 300956 - DNA, 20 bp, Artificial Sequence
  Description of Artificial Sequence: Synthetic oligonucleotide
  Target: ATXN1; (+) strand; PAM type: YTN; PAM sequence: CTG
aagctcaggctaagtaatgg

SEQ ID NO: 300957 - DNA, 20 bp, Artificial Sequence
  Description of Artificial Sequence: Synthetic oligonucleotide
  Target: ATXN1; (+) strand; PAM type: YTN; PAM sequence: CTC
aggctaagtaatgggcccaa

SEQ ID NO: 300958 - DNA, 20 bp, Artificial Sequence
  Description of Artificial Sequence: Synthetic oligonucleotide
  Target: ATXN1; (+) strand; PAM type: YTN; PAM sequence: CTA
agtaatgggcccaagatctc

SEQ ID NO: 300959 - DNA, 20 bp, Artificial Sequence
  Description of Artificial Sequence: Synthetic oligonucleotide
  Target: ATXN1; (+) strand; PAM type: YTN; PAM sequence: CTC
aaattggcagatctgggttc

SEQ ID NO: 300960 - DNA, 20 bp, Artificial Sequence
  Description of Artificial Sequence: Synthetic oligonucleotide
  Target: ATXN1; (+) strand; PAM type: YTN; PAM sequence: TTG
gcagatctgggttcaaaacc

SEQ ID NO: 300961 - DNA, 20 bp, Artificial Sequence
  Description of Artificial Sequence: Synthetic oligonucleotide
  Target: ATXN1; (+) strand; PAM type: YTN; PAM sequence: CTG
ggttcaaaaccttagtcaga

SEQ ID NO: 300962 - DNA, 20 bp, Artificial Sequence
  Description of Artificial Sequence: Synthetic oligonucleotide
  Target: ATXN1; (+) strand; PAM type: YTN; PAM sequence: TTC
aaaaccttagtcagaacgag

SEQ ID NO: 300963 - DNA, 20 bp, Artificial Sequence
  Description of Artificial Sequence: Synthetic oligonucleotide
  Target: ATXN1; (+) strand; PAM type: YTN; PAM sequence: CTT
agtcagaacgagcccagacc

SEQ ID NO: 300964 - DNA, 20 bp, Artificial Sequence
  Description of Artificial Sequence: Synthetic oligonucleotide
  Target: ATXN1; (+) strand; PAM type: YTN; PAM sequence: TTA
gtcagaacgagcccagacct

SEQ ID NO: 300965 - DNA, 20 bp, Artificial Sequence
  Description of Artificial Sequence: Synthetic oligonucleotide
  Target: ATXN1; (+) strand; PAM type: YTN; PAM sequence: CTC
ccatacaggcagaggtcttt

SEQ ID NO: 300966 - DNA, 20 bp, Artificial Sequence
  Description of Artificial Sequence: Synthetic oligonucleotide
  Target: ATXN1; (+) strand; PAM type: YTN; PAM sequence: CTT
tgcagatgggaagatatgga

SEQ ID NO: 300967 - DNA, 20 bp, Artificial Sequence
  Description of Artificial Sequence: Synthetic oligonucleotide
  Target: ATXN1; (+) strand; PAM type: YTN; PAM sequence: TTT
gcagatgggaagatatggat

SEQ ID NO: 300968 - DNA, 20 bp, Artificial Sequence
  Description of Artificial Sequence: Synthetic oligonucleotide
  Target: ATXN1; (+) strand; PAM type: YTN; PAM sequence: TTG
cagatgggaagatatggata

SEQ ID NO: 300969 - DNA, 20 bp, Artificial Sequence
  Description of Artificial Sequence: Synthetic oligonucleotide
  Target: ATXN1; (+) strand; PAM type: YTN; PAM sequence: CTT
tctcctctacttaagctcag

SEQ ID NO: 300970 - DNA, 20 bp, Artificial Sequence
  Description of Artificial Sequence: Synthetic oligonucleotide
  Target: ATXN1; (+) strand; PAM type: YTN; PAM sequence: TTT
ctcctctacttaagctcagt

SEQ ID NO: 300971 - DNA, 20 bp, Artificial Sequence
  Description of Artificial Sequence: Synthetic oligonucleotide
  Target: ATXN1; (+) strand; PAM type: YTN; PAM sequence: TTC
tcctctacttaagctcagtg

SEQ ID NO: 300972 - DNA, 20 bp, Artificial Sequence
  Description of Artificial Sequence: Synthetic oligonucleotide
  Target: ATXN1; (+) strand; PAM type: YTN; PAM sequence: CTC
ctctacttaagctcagtgta

SEQ ID NO: 300973 - DNA, 20 bp, Artificial Sequence
  Description of Artificial Sequence: Synthetic oligonucleotide
  Target: ATXN1; (+) strand; PAM type: YTN; PAM sequence: CTC
tacttaagctcagtgtatct

SEQ ID NO: 300974 - DNA, 20 bp, Artificial Sequence
  Description of Artificial Sequence: Synthetic oligonucleotide
  Target: ATXN1; (+) strand; PAM type: YTN; PAM sequence: CTA
cttaagctcagtgtatctgt

SEQ ID NO: 300975 - DNA, 20 bp, Artificial Sequence
  Description of Artificial Sequence: Synthetic oligonucleotide
  Target: ATXN1; (+) strand; PAM type: YTN; PAM sequence: CTT
aagctcagtgtatctgtaca

SEQ ID NO: 300976 - DNA, 20 bp, Artificial Sequence
  Description of Artificial Sequence: Synthetic oligonucleotide
  Target: ATXN1; (+) strand; PAM type: YTN; PAM sequence: TTA
agctcagtgtatctgtacac

SEQ ID NO: 300977 - DNA, 20 bp, Artificial Sequence
  Description of Artificial Sequence: Synthetic oligonucleotide
  Target: ATXN1; (+) strand; PAM type: YTN; PAM sequence: CTC
agtgtatctgtacactgagt

SEQ ID NO: 300978 - DNA, 20 bp, Artificial Sequence
  Description of Artificial Sequence: Synthetic oligonucleotide
  Target: ATXN1; (+) strand; PAM type: YTN; PAM sequence: CTG
tacactgagtagccatgtag

SEQ ID NO: 300979 - DNA, 20 bp, Artificial Sequence
  Description of Artificial Sequence: Synthetic oligonucleotide
  Target: ATXN1; (+) strand; PAM type: YTN; PAM sequence: CTG
agtagccatgtagcataatg

SEQ ID NO: 300980 - DNA, 20 bp, Artificial Sequence
  Description of Artificial Sequence: Synthetic oligonucleotide
  Target: ATXN1; (+) strand; PAM type: YTN; PAM sequence: CTC
tggagccaaagctctaagtt

SEQ ID NO: 300981 - DNA, 20 bp, Artificial Sequence
  Description of Artificial Sequence: Synthetic oligonucleotide
  Target: ATXN1; (+) strand; PAM type: YTN; PAM sequence: CTG
gagccaaagctctaagttca

SEQ ID NO: 300982 - DNA, 20 bp, Artificial Sequence
  Description of Artificial Sequence: Synthetic oligonucleotide
  Target: ATXN1; (+) strand; PAM type: YTN; PAM sequence: CTC
taagttcagatttcagctcc

SEQ ID NO: 300983 - DNA, 20 bp, Artificial Sequence
  Description of Artificial Sequence: Synthetic oligonucleotide
  Target: ATXN1; (+) strand; PAM type: YTN; PAM sequence: CTA
agttcagatttcagctccgc

SEQ ID NO: 300984 - DNA, 20 bp, Artificial Sequence
  Description of Artificial Sequence: Synthetic oligonucleotide
  Target: ATXN1; (+) strand; PAM type: YTN; PAM sequence: TTC
agatttcagctccgccactc

SEQ ID NO: 300985 - DNA, 20 bp, Artificial Sequence
  Description of Artificial Sequence: Synthetic oligonucleotide
  Target: ATXN1; (+) strand; PAM type: YTN; PAM sequence: TTT
cagctccgccactcactagt

SEQ ID NO: 300986 - DNA, 20 bp, Artificial Sequence
  Description of Artificial Sequence: Synthetic oligonucleotide
  Target: ATXN1; (+) strand; PAM type: YTN; PAM sequence: TTC
agctccgccactcactagtg

SEQ ID NO: 300987 - DNA, 20 bp, Artificial Sequence
  Description of Artificial Sequence: Synthetic oligonucleotide
  Target: ATXN1; (+) strand; PAM type: YTN; PAM sequence: CTC
cgccactcactagtgcatgc

SEQ ID NO: 300988 - DNA, 20 bp, Artificial Sequence
  Description of Artificial Sequence: Synthetic oligonucleotide
  Target: ATXN1; (+) strand; PAM type: YTN; PAM sequence: CTC
actagtgcatgccctaactt

SEQ ID NO: 300989 - DNA, 20 bp, Artificial Sequence
  Description of Artificial Sequence: Synthetic oligonucleotide
  Target: ATXN1; (+) strand; PAM type: YTN; PAM sequence: CTA
gtgcatgccctaacttctct

SEQ ID NO: 300990 - DNA, 20 bp, Artificial Sequence
  Description of Artificial Sequence: Synthetic oligonucleotide
  Target: ATXN1; (+) strand; PAM type: YTN; PAM sequence: CTA
acttctctgtgcctctcagt

SEQ ID NO: 300991 - DNA, 20 bp, Artificial Sequence
  Description of Artificial Sequence: Synthetic oligonucleotide
  Target: ATXN1; (+) strand; PAM type: YTN; PAM sequence: CTT
ctctgtgcctctcagtggcc

SEQ ID NO: 300992 - DNA, 20 bp, Artificial Sequence
  Description of Artificial Sequence: Synthetic oligonucleotide
  Target: ATXN1; (+) strand; PAM type: YTN; PAM sequence: TTC
tctgtgcctctcagtggcct

SEQ ID NO: 300993 - DNA, 20 bp, Artificial Sequence
  Description of Artificial Sequence: Synthetic oligonucleotide
  Target: ATXN1; (+) strand; PAM type: YTN; PAM sequence: CTC
tgtgcctctcagtggcctca

SEQ ID NO: 300994 - DNA, 20 bp, Artificial Sequence
  Description of Artificial Sequence: Synthetic oligonucleotide
  Target: ATXN1; (+) strand; PAM type: YTN; PAM sequence: CTG
tgcctctcagtggcctcagc

SEQ ID NO: 300995 - DNA, 20 bp, Artificial Sequence
  Description of Artificial Sequence: Synthetic oligonucleotide
  Target: ATXN1; (+) strand; PAM type: YTN; PAM sequence: CTC
tcagtggcctcagctctgaa

SEQ ID NO: 300996 - DNA, 20 bp, Artificial Sequence
  Description of Artificial Sequence: Synthetic oligonucleotide
  Target: ATXN1; (+) strand; PAM type: YTN; PAM sequence: CTC
agtggcctcagctctgaaga

SEQ ID NO: 300997 - DNA, 20 bp, Artificial Sequence
  Description of Artificial Sequence: Synthetic oligonucleotide
  Target: ATXN1; (+) strand; PAM type: YTN; PAM sequence: CTC
agctctgaagatgagaatcg

SEQ ID NO: 300998 - DNA, 20 bp, Artificial Sequence
  Description of Artificial Sequence: Synthetic oligonucleotide
  Target: ATXN1; (+) strand; PAM type: YTN; PAM sequence: CTC
tgaagatgagaatcgtaata

SEQ ID NO: 300999 - DNA, 20 bp, Artificial Sequence
  Description of Artificial Sequence: Synthetic oligonucleotide
  Target: ATXN1; (+) strand; PAM type: YTN; PAM sequence: CTG
aagatgagaatcgtaatagt

SEQ ID NO: 301000 - DNA, 20 bp, Artificial Sequence
  Description of Artificial Sequence: Synthetic oligonucleotide
  Target: ATXN1; (+) strand; PAM type: YTN; PAM sequence: CTG
atatctacctactaacaggg

SEQ ID NO: 301001 - DNA, 20 bp, Artificial Sequence
  Description of Artificial Sequence: Synthetic oligonucleotide
  Target: ATXN1; (+) strand; PAM type: YTN; PAM sequence: CTA
cctactaacagggccactgt

SEQ ID NO: 301002 - DNA, 20 bp, Artificial Sequence
  Description of Artificial Sequence: Synthetic oligonucleotide
  Target: ATXN1; (+) strand; PAM type: YTN; PAM sequence: CTA
ctaacagggccactgtgagg

SEQ ID NO: 301003 - DNA, 20 bp, Artificial Sequence
  Description of Artificial Sequence: Synthetic oligonucleotide
  Target: ATXN1; (+) strand; PAM type: YTN; PAM sequence: CTA
acagggccactgtgaggatt

SEQ ID NO: 301004 - DNA, 20 bp, Artificial Sequence
  Description of Artificial Sequence: Synthetic oligonucleotide
  Target: ATXN1; (+) strand; PAM type: YTN; PAM sequence: CTG
tgaggattaaatgagttact

SEQ ID NO: 301005 - DNA, 20 bp, Artificial Sequence
  Description of Artificial Sequence: Synthetic oligonucleotide
  Target: ATXN1; (+) strand; PAM type: YTN; PAM sequence: TTA
aatgagttactacacataca

SEQ ID NO: 301006 - DNA, 20 bp, Artificial Sequence
  Description of Artificial Sequence: Synthetic oligonucleotide
  Target: ATXN1; (+) strand; PAM type: YTN; PAM sequence: TTA
ctacacatacagcacaaaga

SEQ ID NO: 301007 - DNA, 20 bp, Artificial Sequence
  Description of Artificial Sequence: Synthetic oligonucleotide
  Target: ATXN1; (+) strand; PAM type: YTN; PAM sequence: CTA
cacatacagcacaaagaaca

SEQ ID NO: 301008 - DNA, 20 bp, Artificial Sequence
  Description of Artificial Sequence: Synthetic oligonucleotide
  Target: ATXN1; (+) strand; PAM type: YTN; PAM sequence: TTT
agtatcctttgaaatactaa

SEQ ID NO: 301009 - DNA, 20 bp, Artificial Sequence
  Description of Artificial Sequence: Synthetic oligonucleotide
  Target: ATXN1; (+) strand; PAM type: YTN; PAM sequence: TTA
gtatcctttgaaatactaaa

SEQ ID NO: 301010 - DNA, 20 bp, Artificial Sequence
  Description of Artificial Sequence: Synthetic oligonucleotide
  Target: ATXN1; (+) strand; PAM type: YTN; PAM sequence: CTT
tgaaatactaaaaagagcac

SEQ ID NO: 301011 - DNA, 20 bp, Artificial Sequence
  Description of Artificial Sequence: Synthetic oligonucleotide
  Target: ATXN1; (+) strand; PAM type: YTN; PAM sequence: TTT
gaaatactaaaaagagcact

SEQ ID NO: 301012 - DNA, 20 bp, Artificial Sequence
  Description of Artificial Sequence: Synthetic oligonucleotide
  Target: ATXN1; (+) strand; PAM type: YTN; PAM sequence: TTG
aaatactaaaaagagcactg

SEQ ID NO: 301013 - DNA, 20 bp, Artificial Sequence
  Description of Artificial Sequence: Synthetic oligonucleotide
  Target: ATXN1; (+) strand; PAM type: YTN; PAM sequence: CTA
aaaagagcactgaatttgaa

SEQ ID NO: 301014 - DNA, 20 bp, Artificial Sequence
  Description of Artificial Sequence: Synthetic oligonucleotide
  Target: ATXN1; (+) strand; PAM type: YTN; PAM sequence: CTG
aatttgaagtccagtggtct

SEQ ID NO: 301015 - DNA, 20 bp, Artificial Sequence
  Description of Artificial Sequence: Synthetic oligonucleotide
  Target: ATXN1; (+) strand; PAM type: YTN; PAM sequence: TTT
gaagtccagtggtctccgcc

SEQ ID NO: 301016 - DNA, 20 bp, Artificial Sequence
  Description of Artificial Sequence: Synthetic oligonucleotide
  Target: ATXN1; (+) strand; PAM type: YTN; PAM sequence: TTG
aagtccagtggtctccgcca

SEQ ID NO: 301017 - DNA, 20 bp, Artificial Sequence
  Description of Artificial Sequence: Synthetic oligonucleotide
  Target: ATXN1; (+) strand; PAM type: YTN; PAM sequence: CTC
cgccattgatctactgtatg

SEQ ID NO: 301018 - DNA, 20 bp, Artificial Sequence
  Description of Artificial Sequence: Synthetic oligonucleotide
  Target: ATXN1; (+) strand; PAM type: YTN; PAM sequence: TTG
atctactgtatgagcttagg

SEQ ID NO: 301019 - DNA, 20 bp, Artificial Sequence
  Description of Artificial Sequence: Synthetic oligonucleotide
  Target: ATXN1; (+) strand; PAM type: YTN; PAM sequence: CTA
ctgtatgagcttaggcaagt

SEQ ID NO: 301020 - DNA, 20 bp, Artificial Sequence
  Description of Artificial Sequence: Synthetic oligonucleotide
  Target: ATXN1; (+) strand; PAM type: YTN; PAM sequence: CTG
tatgagcttaggcaagtccc

SEQ ID NO: 301021 - DNA, 20 bp, Artificial Sequence
  Description of Artificial Sequence: Synthetic oligonucleotide
  Target: ATXN1; (+) strand; PAM type: YTN; PAM sequence: CTT
aggcaagtccctcaagcttc

SEQ ID NO: 301022 - DNA, 20 bp, Artificial Sequence
  Description of Artificial Sequence: Synthetic oligonucleotide
  Target: ATXN1; (+) strand; PAM type: YTN; PAM sequence: TTA
ggcaagtccctcaagcttcc

SEQ ID NO: 301023 - DNA, 20 bp, Artificial Sequence
  Description of Artificial Sequence: Synthetic oligonucleotide
  Target: ATXN1; (+) strand; PAM type: YTN; PAM sequence: CTC
aagcttcctgagctccactg

SEQ ID NO: 301024 - DNA, 20 bp, Artificial Sequence
  Description of Artificial Sequence: Synthetic oligonucleotide
  Target: ATXN1; (+) strand; PAM type: YTN; PAM sequence: CTT
cctgagctccactgtcctca

SEQ ID NO: 301025 - DNA, 20 bp, Artificial Sequence
  Description of Artificial Sequence: Synthetic oligonucleotide
  Target: ATXN1; (+) strand; PAM type: YTN; PAM sequence: TTC
ctgagctccactgtcctcat

SEQ ID NO: 301026 - DNA, 20 bp, Artificial Sequence
  Description of Artificial Sequence: Synthetic oligonucleotide
  Target: ATXN1; (+) strand; PAM type: YTN; PAM sequence: CTG
agctccactgtcctcatctg

SEQ ID NO: 301027 - DNA, 20 bp, Artificial Sequence
  Description of Artificial Sequence: Synthetic oligonucleotide
  Target: ATXN1; (+) strand; PAM type: YTN; PAM sequence: CTC
cactgtcctcatctgtaaaa

SEQ ID NO: 301028 - DNA, 20 bp, Artificial Sequence
  Description of Artificial Sequence: Synthetic oligonucleotide
  Target: ATXN1; (+) strand; PAM type: YTN; PAM sequence: CTG
tcctcatctgtaaaaatggg

SEQ ID NO: 301029 - DNA, 20 bp, Artificial Sequence
  Description of Artificial Sequence: Synthetic oligonucleotide
  Target: ATXN1; (+) strand; PAM type: YTN; PAM sequence: CTC
atctgtaaaaatgggatacc

SEQ ID NO: 301030 - DNA, 20 bp, Artificial Sequence
  Description of Artificial Sequence: Synthetic oligonucleotide
  Target: ATXN1; (+) strand; PAM type: YTN; PAM sequence: CTG
taaaaatgggataccagcgg

SEQ ID NO: 301031 - DNA, 20 bp, Artificial Sequence
  Description of Artificial Sequence: Synthetic oligonucleotide
  Target: ATXN1; (+) strand; PAM type: YTN; PAM sequence: CTT
gcttcctttccagaacatca

SEQ ID NO: 301032 - DNA, 20 bp, Artificial Sequence
  Description of Artificial Sequence: Synthetic oligonucleotide
  Target: ATXN1; (+) strand; PAM type: YTN; PAM sequence: TTG
cttcctttccagaacatcac

SEQ ID NO: 301033 - DNA, 20 bp, Artificial Sequence
  Description of Artificial Sequence: Synthetic oligonucleotide
  Target: ATXN1; (+) strand; PAM type: YTN; PAM sequence: CTT
cctttccagaacatcacaag

SEQ ID NO: 301034 - DNA, 20 bp, Artificial Sequence
  Description of Artificial Sequence: Synthetic oligonucleotide
  Target: ATXN1; (+) strand; PAM type: YTN; PAM sequence: TTC
ctttccagaacatcacaaga

SEQ ID NO: 301035 - DNA, 20 bp, Artificial Sequence
  Description of Artificial Sequence: Synthetic oligonucleotide
  Target: ATXN1; (+) strand; PAM type: YTN; PAM sequence: CTT
tccagaacatcacaagaaac

SEQ ID NO: 301036 - DNA, 20 bp, Artificial Sequence
  Description of Artificial Sequence: Synthetic oligonucleotide
  Target: ATXN1; (+) strand; PAM type: YTN; PAM sequence: TTT
ccagaacatcacaagaaaca

SEQ ID NO: 301037 - DNA, 20 bp, Artificial Sequence
  Description of Artificial Sequence: Synthetic oligonucleotide
  Target: ATXN1; (+) strand; PAM type: YTN; PAM sequence: TTC
cagaacatcacaagaaacaa

SEQ ID NO: 301038 - DNA, 20 bp, Artificial Sequence
  Description of Artificial Sequence: Synthetic oligonucleotide
  Target: ATXN1; (+) strand; PAM type: YTN; PAM sequence: CTT
tggaagctaaaaagtgctat

SEQ ID NO: 301039 - DNA, 20 bp, Artificial Sequence
  Description of Artificial Sequence: Synthetic oligonucleotide
  Target: ATXN1; (+) strand; PAM type: YTN; PAM sequence: TTT
ggaagctaaaaagtgctata

SEQ ID NO: 301040 - DNA, 20 bp, Artificial Sequence
  Description of Artificial Sequence: Synthetic oligonucleotide
  Target: ATXN1; (+) strand; PAM type: YTN; PAM sequence: TTG
gaagctaaaaagtgctatat

SEQ ID NO: 301041 - DNA, 20 bp, Artificial Sequence
  Description of Artificial Sequence: Synthetic oligonucleotide
  Target: ATXN1; (+) strand; PAM type: YTN; PAM sequence: CTA
aaaagtgctatatataccat

SEQ ID NO: 301042 - DNA, 20 bp, Artificial Sequence
  Description of Artificial Sequence: Synthetic oligonucleotide
  Target: ATXN1; (+) strand; PAM type: YTN; PAM sequence: CTA
tatataccatgtacatgtga

SEQ ID NO: 301043 - DNA, 20 bp, Artificial Sequence
  Description of Artificial Sequence: Synthetic oligonucleotide
  Target: ATXN1; (+) strand; PAM type: YTN; PAM sequence: TTA
tcgtcatcaactttcagcct

SEQ ID NO: 301044 - DNA, 20 bp, Artificial Sequence
  Description of Artificial Sequence: Synthetic oligonucleotide
  Target: ATXN1; (+) strand; PAM type: YTN; PAM sequence: CTT
tcagcctctcaaagccaaag

SEQ ID NO: 301045 - DNA, 20 bp, Artificial Sequence
  Description of Artificial Sequence: Synthetic oligonucleotide
  Target: ATXN1; (+) strand; PAM type: YTN; PAM sequence: TTT
cagcctctcaaagccaaaga

SEQ ID NO: 301046 - DNA, 20 bp, Artificial Sequence
  Description of Artificial Sequence: Synthetic oligonucleotide
  Target: ATXN1; (+) strand; PAM type: YTN; PAM sequence: TTC
agcctctcaaagccaaagag

SEQ ID NO: 301047 - DNA, 20 bp, Artificial Sequence
  Description of Artificial Sequence: Synthetic oligonucleotide
  Target: ATXN1; (+) strand; PAM type: YTN; PAM sequence: CTC
tcaaagccaaagaggtcaat

SEQ ID NO: 301048 - DNA, 20 bp, Artificial Sequence
  Description of Artificial Sequence: Synthetic oligonucleotide
  Target: ATXN1; (+) strand; PAM type: YTN; PAM sequence: CTC
aaagccaaagaggtcaatct

SEQ ID NO: 301049 - DNA, 20 bp, Artificial Sequence
  Description of Artificial Sequence: Synthetic oligonucleotide
  Target: ATXN1; (+) strand; PAM type: YTN; PAM sequence: CTC
tattccattctctcctgcct

SEQ ID NO: 301050 - DNA, 20 bp, Artificial Sequence
  Description of Artificial Sequence: Synthetic oligonucleotide
  Target: ATXN1; (+) strand; PAM type: YTN; PAM sequence: CTA
ttccattctctcctgcctga

SEQ ID NO: 301051 - DNA, 20 bp, Artificial Sequence
  Description of Artificial Sequence: Synthetic oligonucleotide
  Target: ATXN1; (+) strand; PAM type: YTN; PAM sequence: TTC
cattctctcctgcctgagaa

SEQ ID NO: 301052 - DNA, 20 bp, Artificial Sequence
  Description of Artificial Sequence: Synthetic oligonucleotide
  Target: ATXN1; (+) strand; PAM type: YTN; PAM sequence: TTC
tctcctgcctgagaatttaa

SEQ ID NO: 301053 - DNA, 20 bp, Artificial Sequence
  Description of Artificial Sequence: Synthetic oligonucleotide
  Target: ATXN1; (+) strand; PAM type: YTN; PAM sequence: CTC
tcctgcctgagaatttaata

SEQ ID NO: 301054 - DNA, 20 bp, Artificial Sequence
  Description of Artificial Sequence: Synthetic oligonucleotide
  Target: ATXN1; (+) strand; PAM type: YTN; PAM sequence: CTC
ctgcctgagaatttaatact

SEQ ID NO: 301055 - DNA, 20 bp, Artificial Sequence
  Description of Artificial Sequence: Synthetic oligonucleotide
  Target: ATXN1; (+) strand; PAM type: YTN; PAM sequence: CTG
cctgagaatttaatactaag

SEQ ID NO: 301056 - DNA, 20 bp, Artificial Sequence
  Description of Artificial Sequence: Synthetic oligonucleotide
  Target: ATXN1; (+) strand; PAM type: YTN; PAM sequence: CTG
agaatttaatactaagcatc

SEQ ID NO: 301057 - DNA, 20 bp, Artificial Sequence
  Description of Artificial Sequence: Synthetic oligonucleotide
  Target: ATXN1; (+) strand; PAM type: YTN; PAM sequence: TTT
aatactaagcatcagttcca

SEQ ID NO: 301058 - DNA, 20 bp, Artificial Sequence
  Description of Artificial Sequence: Synthetic oligonucleotide
  Target: ATXN1; (+) strand; PAM type: YTN; PAM sequence: TTA
atactaagcatcagttccaa

SEQ ID NO: 301059 - DNA, 20 bp, Artificial Sequence
  Description of Artificial Sequence: Synthetic oligonucleotide
  Target: ATXN1; (+) strand; PAM type: YTN; PAM sequence: CTA
agcatcagttccaaaacctg

SEQ ID NO: 301060 - DNA, 20 bp, Artificial Sequence
  Description of Artificial Sequence: Synthetic oligonucleotide
  Target: ATXN1; (+) strand; PAM type: YTN; PAM sequence: TTC
caaaacctggacactgaact

SEQ ID NO: 301061 - DNA, 20 bp, Artificial Sequence
  Description of Artificial Sequence: Synthetic oligonucleotide
  Target: ATXN1; (+) strand; PAM type: YTN; PAM sequence: CTG
gacactgaactgctaatcat

SEQ ID NO: 301062 - DNA, 20 bp, Artificial Sequence
  Description of Artificial Sequence: Synthetic oligonucleotide
  Target: ATXN1; (+) strand; PAM type: YTN; PAM sequence: CTG
aactgctaatcataacagaa

SEQ ID NO: 301063 - DNA, 20 bp, Artificial Sequence
  Description of Artificial Sequence: Synthetic oligonucleotide
  Target: ATXN1; (+) strand; PAM type: YTN; PAM sequence: CTG
ctaatcataacagaacacat

SEQ ID NO: 301064 - DNA, 20 bp, Artificial Sequence
  Description of Artificial Sequence: Synthetic oligonucleotide
  Target: ATXN1; (+) strand; PAM type: YTN; PAM sequence: CTA
atcataacagaacacatgtc

SEQ ID NO: 301065 - DNA, 20 bp, Artificial Sequence
  Description of Artificial Sequence: Synthetic oligonucleotide
  Target: ATXN1; (+) strand; PAM type: YTN; PAM sequence: CTT
gatcaaacagaactctatta

SEQ ID NO: 301066 - DNA, 20 bp, Artificial Sequence
  Description of Artificial Sequence: Synthetic oligonucleotide
  Target: ATXN1; (+) strand; PAM type: YTN; PAM sequence: TTG
atcaaacagaactctattaa

SEQ ID NO: 301067 - DNA, 20 bp, Artificial Sequence
  Description of Artificial Sequence: Synthetic oligonucleotide
  Target: ATXN1; (+) strand; PAM type: YTN; PAM sequence: CTC
tattaactacctccttctgc

SEQ ID NO: 301068 - DNA, 20 bp, Artificial Sequence
  Description of Artificial Sequence: Synthetic oligonucleotide
  Target: ATXN1; (+) strand; PAM type: YTN; PAM sequence: CTA
ttaactacctccttctgcac

SEQ ID NO: 301069 - DNA, 20 bp, Artificial Sequence
  Description of Artificial Sequence: Synthetic oligonucleotide
  Target: ATXN1; (+) strand; PAM type: YTN; PAM sequence: TTA
actacctccttctgcacacc

SEQ ID NO: 301070 - DNA, 20 bp, Artificial Sequence
  Description of Artificial Sequence: Synthetic oligonucleotide
  Target: ATXN1; (+) strand; PAM type: YTN; PAM sequence: CTA
cctccttctgcacacccacc

SEQ ID NO: 301071 - DNA, 20 bp, Artificial Sequence
  Description of Artificial Sequence: Synthetic oligonucleotide
  Target: ATXN1; (+) strand; PAM type: YTN; PAM sequence: CTC
cttctgcacacccaccgtga

SEQ ID NO: 301072 - DNA, 20 bp, Artificial Sequence
  Description of Artificial Sequence: Synthetic oligonucleotide
  Target: ATXN1; (+) strand; PAM type: YTN; PAM sequence: CTT
ctgcacacccaccgtgagaa

SEQ ID NO: 301073 - DNA, 20 bp, Artificial Sequence
  Description of Artificial Sequence: Synthetic oligonucleotide
  Target: ATXN1; (+) strand; PAM type: YTN; PAM sequence: TTC
tgcacacccaccgtgagaac

SEQ ID NO: 301074 - DNA, 20 bp, Artificial Sequence
  Description of Artificial Sequence: Synthetic oligonucleotide
  Target: ATXN1; (+) strand; PAM type: YTN; PAM sequence: CTG
cacacccaccgtgagaacat

SEQ ID NO: 301075 - DNA, 20 bp, Artificial Sequence
  Description of Artificial Sequence: Synthetic oligonucleotide
  Target: ATXN1; (+) strand; PAM type: YTN; PAM sequence: TTG
atgctcatcatggccctaaa

SEQ ID NO: 301076 - DNA, 20 bp, Artificial Sequence
  Description of Artificial Sequence: Synthetic oligonucleotide
  Target: ATXN1; (+) strand; PAM type: YTN; PAM sequence: CTC
atcatggccctaaagcactc

SEQ ID NO: 301077 - DNA, 20 bp, Artificial Sequence
  Description of Artificial Sequence: Synthetic oligonucleotide
  Target: ATXN1; (+) strand; PAM type: YTN; PAM sequence: CTA
aagcactccaagactctgaa

SEQ ID NO: 301078 - DNA, 20 bp, Artificial Sequence
  Description of Artificial Sequence: Synthetic oligonucleotide
  Target: ATXN1; (+) strand; PAM type: YTN; PAM sequence: CTC
caagactctgaagtaccttc

SEQ ID NO: 301079 - DNA, 20 bp, Artificial Sequence
  Description of Artificial Sequence: Synthetic oligonucleotide
  Target: ATXN1; (+) strand; PAM type: YTN; PAM sequence: CTC
tgaagtaccttcagggaaag

SEQ ID NO: 301080 - DNA, 20 bp, Artificial Sequence
  Description of Artificial Sequence: Synthetic oligonucleotide
  Target: ATXN1; (+) strand; PAM type: YTN; PAM sequence: CTG
aagtaccttcagggaaagat

SEQ ID NO: 301081 - DNA, 20 bp, Artificial Sequence
  Description of Artificial Sequence: Synthetic oligonucleotide
  Target: ATXN1; (+) strand; PAM type: YTN; PAM sequence: CTT
cagggaaagattaaattatg

SEQ ID NO: 301082 - DNA, 20 bp, Artificial Sequence
  Description of Artificial Sequence: Synthetic oligonucleotide
  Target: ATXN1; (+) strand; PAM type: YTN; PAM sequence: TTC
agggaaagattaaattatgt

SEQ ID NO: 301083 - DNA, 20 bp, Artificial Sequence
  Description of Artificial Sequence: Synthetic oligonucleotide
  Target: ATXN1; (+) strand; PAM type: YTN; PAM sequence: TTA
aattatgttcagcctagttt

SEQ ID NO: 301084 - DNA, 20 bp, Artificial Sequence
  Description of Artificial Sequence: Synthetic oligonucleotide
  Target: ATXN1; (+) strand; PAM type: YTN; PAM sequence: TTA
tgttcagcctagtttattat

SEQ ID NO: 301085 - DNA, 20 bp, Artificial Sequence
  Description of Artificial Sequence: Synthetic oligonucleotide
  Target: ATXN1; (+) strand; PAM type: YTN; PAM sequence: TTC
agcctagtttattatgaagt

SEQ ID NO: 301086 - DNA, 20 bp, Artificial Sequence
  Description of Artificial Sequence: Synthetic oligonucleotide
  Target: ATXN1; (+) strand; PAM type: YTN; PAM sequence: CTA
gtttattatgaagtgtattt

SEQ ID NO: 301087 - DNA, 20 bp, Artificial Sequence
  Description of Artificial Sequence: Synthetic oligonucleotide
  Target: ATXN1; (+) strand; PAM type: YTN; PAM sequence: TTT
attatgaagtgtatttaatt

SEQ ID NO: 301088 - DNA, 20 bp, Artificial Sequence
  Description of Artificial Sequence: Synthetic oligonucleotide
  Target: ATXN1; (+) strand; PAM type: YTN; PAM sequence: TTA
ttatgaagtgtatttaatta

SEQ ID NO: 301089 - DNA, 20 bp, Artificial Sequence
  Description of Artificial Sequence: Synthetic oligonucleotide
  Target: ATXN1; (+) strand; PAM type: YTN; PAM sequence: TTA
tgaagtgtatttaattatac

SEQ ID NO: 301090 - DNA, 20 bp, Artificial Sequence
  Description of Artificial Sequence: Synthetic oligonucleotide
  Target: ATXN1; (+) strand; PAM type: YTN; PAM sequence: TTT
aattatactcaaattctttg

SEQ ID NO: 301091 - DNA, 20 bp, Artificial Sequence
  Description of Artificial Sequence: Synthetic oligonucleotide
  Target: ATXN1; (+) strand; PAM type: YTN; PAM sequence: TTA
attatactcaaattctttga

SEQ ID NO: 301092 - DNA, 20 bp, Artificial Sequence
  Description of Artificial Sequence: Synthetic oligonucleotide
  Target: ATXN1; (+) strand; PAM type: YTN; PAM sequence: TTA
tactcaaattctttgaaaat

SEQ ID NO: 301093 - DNA, 20 bp, Artificial Sequence
  Description of Artificial Sequence: Synthetic oligonucleotide
  Target: ATXN1; (+) strand; PAM type: YTN; PAM sequence: CTC
aaattctttgaaaattggtg

SEQ ID NO: 301094 - DNA, 20 bp, Artificial Sequence
  Description of Artificial Sequence: Synthetic oligonucleotide
  Target: ATXN1; (+) strand; PAM type: YTN; PAM sequence: TTC
tttgaaaattggtgacctag

SEQ ID NO: 301095 - DNA, 20 bp, Artificial Sequence
  Description of Artificial Sequence: Synthetic oligonucleotide
  Target: ATXN1; (+) strand; PAM type: YTN; PAM sequence: CTT
tgaaaattggtgacctagga

SEQ ID NO: 301096 - DNA, 20 bp, Artificial Sequence
  Description of Artificial Sequence: Synthetic oligonucleotide
  Target: ATXN1; (+) strand; PAM type: YTN; PAM sequence: TTT
gaaaattggtgacctaggaa

SEQ ID NO: 301097 - DNA, 20 bp, Artificial Sequence
  Description of Artificial Sequence: Synthetic oligonucleotide
  Target: ATXN1; (+) strand; PAM type: YTN; PAM sequence: TTG
aaaattggtgacctaggaaa

SEQ ID NO: 301098 - DNA, 20 bp, Artificial Sequence
  Description of Artificial Sequence: Synthetic oligonucleotide
  Target: ATXN1; (+) strand; PAM type: YTN; PAM sequence: TTG
gtgacctaggaaaagcacag

SEQ ID NO: 301099 - DNA, 20 bp, Artificial Sequence
  Description of Artificial Sequence: Synthetic oligonucleotide
  Target: ATXN1; (+) strand; PAM type: YTN; PAM sequence: CTA
ggaaaagcacagagagtaag

SEQ ID NO: 301100 - DNA, 20 bp, Artificial Sequence
  Description of Artificial Sequence: Synthetic oligonucleotide
  Target: ATXN1; (+) strand; PAM type: YTN; PAM sequence: CTC
tctggtaactggaagcctct

SEQ ID NO: 301101 - DNA, 20 bp, Artificial Sequence
  Description of Artificial Sequence: Synthetic oligonucleotide
  Target: ATXN1; (+) strand; PAM type: YTN; PAM sequence: CTC
tggtaactggaagcctctcc

SEQ ID NO: 301102 - DNA, 20 bp, Artificial Sequence
  Description of Artificial Sequence: Synthetic oligonucleotide
  Target: ATXN1; (+) strand; PAM type: YTN; PAM sequence: CTG
gtaactggaagcctctcctc

SEQ ID NO: 301103 - DNA, 20 bp, Artificial Sequence
  Description of Artificial Sequence: Synthetic oligonucleotide
  Target: ATXN1; (+) strand; PAM type: YTN; PAM sequence: CTG
gaagcctctcctcaccagtc

SEQ ID NO: 301104 - DNA, 20 bp, Artificial Sequence
  Description of Artificial Sequence: Synthetic oligonucleotide
  Target: ATXN1; (+) strand; PAM type: YTN; PAM sequence: CTC
tcctcaccagtccaccccca

SEQ ID NO: 301105 - DNA, 20 bp, Artificial Sequence
  Description of Artificial Sequence: Synthetic oligonucleotide
  Target: ATXN1; (+) strand; PAM type: YTN; PAM sequence: CTC
ctcaccagtccacccccagt

SEQ ID NO: 301106 - DNA, 20 bp, Artificial Sequence
  Description of Artificial Sequence: Synthetic oligonucleotide
  Target: ATXN1; (+) strand; PAM type: YTN; PAM sequence: CTC
accagtccacccccagtcac

SEQ ID NO: 301107 - DNA, 20 bp, Artificial Sequence
  Description of Artificial Sequence: Synthetic oligonucleotide
  Target: ATXN1; (+) strand; PAM type: YTN; PAM sequence: CTT
cacagagttaattgtaaaaa

SEQ ID NO: 301108 - DNA, 20 bp, Artificial Sequence
  Description of Artificial Sequence: Synthetic oligonucleotide
  Target: ATXN1; (+) strand; PAM type: YTN; PAM sequence: TTC
acagagttaattgtaaaaaa

SEQ ID NO: 301109 - DNA, 20 bp, Artificial Sequence
  Description of Artificial Sequence: Synthetic oligonucleotide
  Target: ATXN1; (+) strand; PAM type: YTN; PAM sequence: TTA
attgtaaaaaatacagtcca

SEQ ID NO: 301110 - DNA, 20 bp, Artificial Sequence
  Description of Artificial Sequence: Synthetic oligonucleotide
  Target: ATXN1; (+) strand; PAM type: YTN; PAM sequence: TTG
taaaaaatacagtccaccct

SEQ ID NO: 301111 - DNA, 20 bp, Artificial Sequence
  Description of Artificial Sequence: Synthetic oligonucleotide
  Target: ATXN1; (+) strand; PAM type: YTN; PAM sequence: CTA
gggtaggaaaaactgggatt

SEQ ID NO: 301112 - DNA, 20 bp, Artificial Sequence
  Description of Artificial Sequence: Synthetic oligonucleotide
  Target: ATXN1; (+) strand; PAM type: YTN; PAM sequence: CTG
ggattccgacacactaatta

SEQ ID NO: 301113 - DNA, 20 bp, Artificial Sequence
  Description of Artificial Sequence: Synthetic oligonucleotide
  Target: ATXN1; (+) strand; PAM type: YTN; PAM sequence: TTC
cgacacactaattataaaag

SEQ ID NO: 301114 - DNA, 20 bp, Artificial Sequence
  Description of Artificial Sequence: Synthetic oligonucleotide
  Target: ATXN1; (+) strand; PAM type: YTN; PAM sequence: CTA
attataaaagtcaaaagaac

SEQ ID NO: 301115 - DNA, 20 bp, Artificial Sequence
  Description of Artificial Sequence: Synthetic oligonucleotide
  Target: ATXN1; (+) strand; PAM type: YTN; PAM sequence: TTA
taaaagtcaaaagaacttgg

SEQ ID NO: 301116 - DNA, 20 bp, Artificial Sequence
  Description of Artificial Sequence: Synthetic oligonucleotide
  Target: ATXN1; (+) strand; PAM type: YTN; PAM sequence: CTT
ggccttgcctaatcttcaag

SEQ ID NO: 301117 - DNA, 20 bp, Artificial Sequence
  Description of Artificial Sequence: Synthetic oligonucleotide
  Target: ATXN1; (+) strand; PAM type: YTN; PAM sequence: TTG
gccttgcctaatcttcaagg

SEQ ID NO: 301118 - DNA, 20 bp, Artificial Sequence
  Description of Artificial Sequence: Synthetic oligonucleotide
  Target: ATXN1; (+) strand; PAM type: YTN; PAM sequence: CTT
gcctaatcttcaaggatcac

SEQ ID NO: 301119 - DNA, 20 bp, Artificial Sequence
  Description of Artificial Sequence: Synthetic oligonucleotide
  Target: ATXN1; (+) strand; PAM type: YTN; PAM sequence: TTG
cctaatcttcaaggatcact

SEQ ID NO: 301120 - DNA, 20 bp, Artificial Sequence
  Description of Artificial Sequence: Synthetic oligonucleotide
  Target: ATXN1; (+) strand; PAM type: YTN; PAM sequence: CTA
atcttcaaggatcactaatg

SEQ ID NO: 301121 - DNA, 20 bp, Artificial Sequence
  Description of Artificial Sequence: Synthetic oligonucleotide
  Target: ATXN1; (+) strand; PAM type: YTN; PAM sequence: CTT
caaggatcactaatgtgcag

SEQ ID NO: 301122 - DNA, 20 bp, Artificial Sequence
  Description of Artificial Sequence: Synthetic oligonucleotide
  Target: ATXN1; (+) strand; PAM type: YTN; PAM sequence: TTC
aaggatcactaatgtgcaga

SEQ ID NO: 301123 - DNA, 20 bp, Artificial Sequence
  Description of Artificial Sequence: Synthetic oligonucleotide
  Target: ATXN1; (+) strand; PAM type: YTN; PAM sequence: CTA
atgtgcagaaatacaaaagt

SEQ ID NO: 301124 - DNA, 20 bp, Artificial Sequence
  Description of Artificial Sequence: Synthetic oligonucleotide
  Target: ATXN1; (+) strand; PAM type: YTN; PAM sequence: CTT
gaaacaatgaaaaatttaat

SEQ ID NO: 301125 - DNA, 20 bp, Artificial Sequence
  Description of Artificial Sequence: Synthetic oligonucleotide
  Target: ATXN1; (+) strand; PAM type: YTN; PAM sequence: TTG
aaacaatgaaaaatttaatc

SEQ ID NO: 301126 - DNA, 20 bp, Artificial Sequence
  Description of Artificial Sequence: Synthetic oligonucleotide
  Target: ATXN1; (+) strand; PAM type: YTN; PAM sequence: TTT
aatctacctaagatgcctac

SEQ ID NO: 301127 - DNA, 20 bp, Artificial Sequence
  Description of Artificial Sequence: Synthetic oligonucleotide
  Target: ATXN1; (+) strand; PAM type: YTN; PAM sequence: TTA
atctacctaagatgcctaca

SEQ ID NO: 301128 - DNA, 20 bp, Artificial Sequence
  Description of Artificial Sequence: Synthetic oligonucleotide
  Target: ATXN1; (+) strand; PAM type: YTN; PAM sequence: CTA
cctaagatgcctacatgttt

SEQ ID NO: 301129 - DNA, 20 bp, Artificial Sequence
  Description of Artificial Sequence: Synthetic oligonucleotide
  Target: ATXN1; (+) strand; PAM type: YTN; PAM sequence: CTA
agatgcctacatgtttcaaa

SEQ ID NO: 301130 - DNA, 20 bp, Artificial Sequence
  Description of Artificial Sequence: Synthetic oligonucleotide
  Target: ATXN1; (+) strand; PAM type: YTN; PAM sequence: CTA
catgtttcaaatagactttt

SEQ ID NO: 301131 - DNA, 20 bp, Artificial Sequence
  Description of Artificial Sequence: Synthetic oligonucleotide
  Target: ATXN1; (+) strand; PAM type: YTN; PAM sequence: TTT
caaatagacttttgttcttg

SEQ ID NO: 301132 - DNA, 20 bp, Artificial Sequence
  Description of Artificial Sequence: Synthetic oligonucleotide
  Target: ATXN1; (+) strand; PAM type: YTN; PAM sequence: TTC
aaatagacttttgttcttgc

SEQ ID NO: 301133 - DNA, 20 bp, Artificial Sequence
  Description of Artificial Sequence: Synthetic oligonucleotide
  Target: ATXN1; (+) strand; PAM type: YTN; PAM sequence: CTT
ttgttcttgctaagaatgaa

SEQ ID NO: 301134 - DNA, 20 bp, Artificial Sequence
  Description of Artificial Sequence: Synthetic oligonucleotide
  Target: ATXN1; (+) strand; PAM type: YTN; PAM sequence: TTT
tgttcttgctaagaatgaat

SEQ ID NO: 301135 - DNA, 20 bp, Artificial Sequence
  Description of Artificial Sequence: Synthetic oligonucleotide
  Target: ATXN1; (+) strand; PAM type: YTN; PAM sequence: TTT
gttcttgctaagaatgaatt

SEQ ID NO: 301136 - DNA, 20 bp, Artificial Sequence
  Description of Artificial Sequence: Synthetic oligonucleotide
  Target: ATXN1; (+) strand; PAM type: YTN; PAM sequence: TTG
ttcttgctaagaatgaattc

SEQ ID NO: 301137 - DNA, 20 bp, Artificial Sequence
  Description of Artificial Sequence: Synthetic oligonucleotide
  Target: ATXN1; (+) strand; PAM type: YTN; PAM sequence: TTC
ttgctaagaatgaattcaat

SEQ ID NO: 301138 - DNA, 20 bp, Artificial Sequence
  Description of Artificial Sequence: Synthetic oligonucleotide
  Target: ATXN1; (+) strand; PAM type: YTN; PAM sequence: CTT
gctaagaatgaattcaattg

SEQ ID NO: 301139 - DNA, 20 bp, Artificial Sequence
  Description of Artificial Sequence: Synthetic oligonucleotide
  Target: ATXN1; (+) strand; PAM type: YTN; PAM sequence: TTG
ctaagaatgaattcaattgt

SEQ ID NO: 301140 - DNA, 20 bp, Artificial Sequence
  Description of Artificial Sequence: Synthetic oligonucleotide
  Target: ATXN1; (+) strand; PAM type: YTN; PAM sequence: CTA
agaatgaattcaattgtttg

SEQ ID NO: 301141 - DNA, 20 bp, Artificial Sequence
  Description of Artificial Sequence: Synthetic oligonucleotide
  Target: ATXN1; (+) strand; PAM type: YTN; PAM sequence: TTC
aattgtttgaacaaaaaata

SEQ ID NO: 301142 - DNA, 20 bp, Artificial Sequence
  Description of Artificial Sequence: Synthetic oligonucleotide
  Target: ATXN1; (+) strand; PAM type: YTN; PAM sequence: TTG
tttgaacaaaaaataacaca

SEQ ID NO: 301143 - DNA, 20 bp, Artificial Sequence
  Description of Artificial Sequence: Synthetic oligonucleotide
  Target: ATXN1; (+) strand; PAM type: YTN; PAM sequence: TTT
gaacaaaaaataacacaaat

SEQ ID NO: 301144 - DNA, 20 bp, Artificial Sequence
  Description of Artificial Sequence: Synthetic oligonucleotide
  Target: ATXN1; (+) strand; PAM type: YTN; PAM sequence: TTG
aacaaaaaataacacaaata

SEQ ID NO: 301145 - DNA, 20 bp, Artificial Sequence
  Description of Artificial Sequence: Synthetic oligonucleotide
  Target: ATXN1; (+) strand; PAM type: YTN; PAM sequence: CTA
tccgattatcagtactcaaa

SEQ ID NO: 301146 - DNA, 20 bp, Artificial Sequence
  Description of Artificial Sequence: Synthetic oligonucleotide
  Target: ATXN1; (+) strand; PAM type: YTN; PAM sequence: TTA
tcagtactcaaaaatataaa

SEQ ID NO: 301147 - DNA, 20 bp, Artificial Sequence
  Description of Artificial Sequence: Synthetic oligonucleotide
  Target: ATXN1; (+) strand; PAM type: YTN; PAM sequence: CTC
aaaaatataaaaacagagga

SEQ ID NO: 301148 - DNA, 20 bp, Artificial Sequence
  Description of Artificial Sequence: Synthetic oligonucleotide
  Target: ATXN1; (+) strand; PAM type: YTN; PAM sequence: TTA
gtattatgctcctgagaaga

SEQ ID NO: 301149 - DNA, 20 bp, Artificial Sequence
  Description of Artificial Sequence: Synthetic oligonucleotide
  Target: ATXN1; (+) strand; PAM type: YTN; PAM sequence: TTA
tgctcctgagaagaggaaat

SEQ ID NO: 301150 - DNA, 20 bp, Artificial Sequence
  Description of Artificial Sequence: Synthetic oligonucleotide
  Target: ATXN1; (+) strand; PAM type: YTN; PAM sequence: CTC
ctgagaagaggaaattaaca

SEQ ID NO: 301151 - DNA, 20 bp, Artificial Sequence
  Description of Artificial Sequence: Synthetic oligonucleotide
  Target: ATXN1; (+) strand; PAM type: YTN; PAM sequence: CTG
agaagaggaaattaacattt

SEQ ID NO: 301152 - DNA, 20 bp, Artificial Sequence
  Description of Artificial Sequence: Synthetic oligonucleotide
  Target: ATXN1; (+) strand; PAM type: YTN; PAM sequence: TTA
acatttagtttactgggtaa

SEQ ID NO: 301153 - DNA, 20 bp, Artificial Sequence
  Description of Artificial Sequence: Synthetic oligonucleotide
  Target: ATXN1; (+) strand; PAM type: YTN; PAM sequence: TTT
agtttactgggtaagttttg

SEQ ID NO: 301154 - DNA, 20 bp, Artificial Sequence
  Description of Artificial Sequence: Synthetic oligonucleotide
  Target: ATXN1; (+) strand; PAM type: YTN; PAM sequence: TTA
gtttactgggtaagttttgt

SEQ ID NO: 301155 - DNA, 20 bp, Artificial Sequence
  Description of Artificial Sequence: Synthetic oligonucleotide
  Target: ATXN1; (+) strand; PAM type: YTN; PAM sequence: TTT
actgggtaagttttgtcact

SEQ ID NO: 301156 - DNA, 20 bp, Artificial Sequence
  Description of Artificial Sequence: Synthetic oligonucleotide
  Target: ATXN1; (+) strand; PAM type: YTN; PAM sequence: TTA
ctgggtaagttttgtcactt

SEQ ID NO: 301157 - DNA, 20 bp, Artificial Sequence
  Description of Artificial Sequence: Synthetic oligonucleotide
  Target: ATXN1; (+) strand; PAM type: YTN; PAM sequence: CTG
ggtaagttttgtcacttctt

SEQ ID NO: 301158 - DNA, 20 bp, Artificial Sequence
  Description of Artificial Sequence: Synthetic oligonucleotide
  Target: ATXN1; (+) strand; PAM type: YTN; PAM sequence: TTT
tgtcacttcttttttttttt

SEQ ID NO: 301159 - DNA, 20 bp, Artificial Sequence
  Description of Artificial Sequence: Synthetic oligonucleotide
  Target: ATXN1; (+) strand; PAM type: YTN; PAM sequence: TTT
gtcacttctttttttttttt

SEQ ID NO: 301160 - DNA, 20 bp, Artificial Sequence
  Description of Artificial Sequence: Synthetic oligonucleotide
  Target: ATXN1; (+) strand; PAM type: YTN; PAM sequence: TTG
tcacttcttttttttttttc

SEQ ID NO: 301161 - DNA, 20 bp, Artificial Sequence
  Description of Artificial Sequence: Synthetic oligonucleotide
  Target: ATXN1; (+) strand; PAM type: YTN; PAM sequence: CTT
cttttttttttttctttttt

SEQ ID NO: 301162 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttcttttttt

SEQ ID NO: 301163 - DNA, 20 bp, Artificial Sequence
  Description of Artificial Sequence: Synthetic oligonucleotide
  Target: ATXN1; (+) strand; PAM type: YTN; PAM sequence: CTT
ttttttttttcttttttttt

SEQ ID NO: 301164 - DNA, 20 bp, Artificial Sequence
  Description of Artificial Sequence: Synthetic oligonucleotide
  Target: ATXN1; (+) strand; PAM type: YTN; PAM sequence: TTT
tttttttttctttttttttt

SEQ ID NO: 301165 - DNA, 20 bp, Artificial Sequence
  Description of Artificial Sequence: Synthetic oligonucleotide
  Target: ATXN1; (+) strand; PAM type: YTN; PAM sequence: TTT
ttttttttcttttttttttt

SEQ ID NO: 301166 - DNA, 20 bp, Artificial Sequence
  Description of Artificial Sequence: Synthetic oligonucleotide
  Target: ATXN1; (+) strand; PAM type: YTN; PAM sequence: TTT
tttttttctttttttttttt

SEQ ID NO: 301167 - DNA, 20 bp, Artificial Sequence
  Description of Artificial Sequence: Synthetic oligonucleotide
  Target: ATXN1; (+) strand; PAM type: YTN; PAM sequence: TTT
ttttttcttttttttttttt

SEQ ID NO: 301168 - DNA, 20 bp, Artificial Sequence
  Description of Artificial Sequence: Synthetic oligonucleotide
  Target: ATXN1; (+) strand; PAM type: YTN; PAM sequence: TTT
tttttctttttttttttttt

SEQ ID NO: 301169 - DNA, 20 bp, Artificial Sequence
  Description of Artificial Sequence: Synthetic oligonucleotide
  Target: ATXN1; (+) strand; PAM type: YTN; PAM sequence: TTT
ttttcttttttttttttttt

SEQ ID NO: 301170 - DNA, 20 bp, Artificial Sequence
  Description of Artificial Sequence: Synthetic oligonucleotide
  Target: ATXN1; (+) strand; PAM type: YTN; PAM sequence: TTT
tttctttttttttttttttt

SEQ ID NO: 301171 - DNA, 20 bp, Artificial Sequence
  Description of Artificial Sequence: Synthetic oligonucleotide
  Target: ATXN1; (+) strand; PAM type: YTN; PAM sequence: TTT
ttctttttttttttttttta

SEQ ID NO: 301172 - DNA, 20 bp, Artificial Sequence
  Description of Artificial Sequence: Synthetic oligonucleotide
  Target: ATXN1; (+) strand; PAM type: YTN; PAM sequence: TTT
tcttttttttttttttttaa

SEQ ID NO: 301173 - DNA, 20 bp, Artificial Sequence
  Description of Artificial Sequence: Synthetic oligonucleotide
  Target: ATXN1; (+) strand; PAM type: YTN; PAM sequence: TTT
cttttttttttttttttaag

SEQ ID NO: 301174 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttttttaaga

SEQ ID NO: 301175 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttttaagaga

SEQ ID NO: 301176 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttaagagac

SEQ ID NO: 301177 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttaagagacg

SEQ ID NO: 301178 - DNA, 20 bp, Artificial Sequence
  Description of Artificial Sequence: Synthetic oligonucleotide
  Target: ATXN1; (+) strand; PAM type: YTN; PAM sequence: TTT
tttttttttttaagagacgg

SEQ ID NO: 301179 - DNA, 20 bp, Artificial Sequence
  Description of Artificial Sequence: Synthetic oligonucleotide
  Target: ATXN1; (+) strand; PAM type: YTN; PAM sequence: TTT
ttttttttttaagagacgga

SEQ ID NO: 301180 - DNA, 20 bp, Artificial Sequence
  Description of Artificial Sequence: Synthetic oligonucleotide
  Target: ATXN1; (+) strand; PAM type: YTN; PAM sequence: TTT
tttttttttaagagacggag

SEQ ID NO: 301181 - DNA, 20 bp, Artificial Sequence
  Description of Artificial Sequence: Synthetic oligonucleotide
  Target: ATXN1; (+) strand; PAM type: YTN; PAM sequence: TTT
ttttttttaagagacggagt

SEQ ID NO: 301182 - DNA, 20 bp, Artificial Sequence
  Description of Artificial Sequence: Synthetic oligonucleotide
  Target: ATXN1; (+) strand; PAM type: YTN; PAM sequence: TTT
tttttttaagagacggagtc

SEQ ID NO: 301183 - DNA, 20 bp, Artificial Sequence
  Description of Artificial Sequence: Synthetic oligonucleotide
  Target: ATXN1; (+) strand; PAM type: YTN; PAM sequence: TTT
ttttttaagagacggagtct

SEQ ID NO: 301184 - DNA, 20 bp, Artificial Sequence
  Description of Artificial Sequence: Synthetic oligonucleotide
  Target: ATXN1; (+) strand; PAM type: YTN; PAM sequence: TTT
tttttaagagacggagtctc

SEQ ID NO: 301185 - DNA, 20 bp, Artificial Sequence
  Description of Artificial Sequence: Synthetic oligonucleotide
  Target: ATXN1; (+) strand; PAM type: YTN; PAM sequence: TTT
ttttaagagacggagtctcg

SEQ ID NO: 301186 - DNA, 20 bp, Artificial Sequence
  Description of Artificial Sequence: Synthetic oligonucleotide
  Target: ATXN1; (+) strand; PAM type: YTN; PAM sequence: TTT
tttaagagacggagtctcgc

SEQ ID NO: 301187 - DNA, 20 bp, Artificial Sequence
  Description of Artificial Sequence: Synthetic oligonucleotide
  Target: ATXN1; (+) strand; PAM type: YTN; PAM sequence: TTT
ttaagagacggagtctcgct

SEQ ID NO: 301188 - DNA, 20 bp, Artificial Sequence
  Description of Artificial Sequence: Synthetic oligonucleotide
  Target: ATXN1; (+) strand; PAM type: YTN; PAM sequence: TTT
taagagacggagtctcgctc

SEQ ID NO: 301189 - DNA, 20 bp, Artificial Sequence
  Description of Artificial Sequence: Synthetic oligonucleotide
  Target: ATXN1; (+) strand; PAM type: YTN; PAM sequence: TTT
aagagacggagtctcgctct

SEQ ID NO: 301190 - DNA, 20 bp, Artificial Sequence
  Description of Artificial Sequence: Synthetic oligonucleotide
  Target: ATXN1; (+) strand; PAM type: YTN; PAM sequence: TTA
agagacggagtctcgctctg

SEQ ID NO: 301191 - DNA, 20 bp, Artificial Sequence
  Description of Artificial Sequence: Synthetic oligonucleotide
  Target: ATXN1; (+) strand; PAM type: YTN; PAM sequence: CTC
gctctgtcgccaggctggag

SEQ ID NO: 301192 - DNA, 20 bp, Artificial Sequence
  Description of Artificial Sequence: Synthetic oligonucleotide
  Target: ATXN1; (+) strand; PAM type: YTN; PAM sequence: CTC
tgtcgccaggctggagtgca

SEQ ID NO: 301193 - DNA, 20 bp, Artificial Sequence
  Description of Artificial Sequence: Synthetic oligonucleotide
  Target: ATXN1; (+) strand; PAM type: YTN; PAM sequence: CTG
tcgccaggctggagtgcagt

SEQ ID NO: 301194 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgtgatctt

SEQ ID NO: 301195 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaagctccgcc

SEQ ID NO: 301196 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaagctccgccg

SEQ ID NO: 301197 - DNA, 20 bp, Artificial Sequence
  Description of Artificial Sequence: Synthetic oligonucleotide
  Target: ATXN1; (+) strand; PAM type: YTN; PAM sequence: CTC
actgcaagctccgccgcctc

SEQ ID NO: 301198 - DNA, 20 bp, Artificial Sequence
  Description of Artificial Sequence: Synthetic oligonucleotide
  Target: ATXN1; (+) strand; PAM type: YTN; PAM sequence: CTG
caagctccgccgcctcctgg

SEQ ID NO: 301199 - DNA, 20 bp, Artificial Sequence
  Description of Artificial Sequence: Synthetic oligonucleotide
  Target: ATXN1; (+) strand; PAM type: YTN; PAM sequence: CTC
cgccgcctcctggttctagc

SEQ ID NO: 301200 - DNA, 20 bp, Artificial Sequence
  Description of Artificial Sequence: Synthetic oligonucleotide
  Target: ATXN1; (+) strand; PAM type: YTN; PAM sequence: CTC
ctggttctagcaactctcct

SEQ ID NO: 301201 - DNA, 20 bp, Artificial Sequence
  Description of Artificial Sequence: Synthetic oligonucleotide
  Target: ATXN1; (+) strand; PAM type: YTN; PAM sequence: CTG
gttctagcaactctcctgcc

SEQ ID NO: 301202 - DNA, 20 bp, Artificial Sequence
  Description of Artificial Sequence: Synthetic oligonucleotide
  Target: ATXN1; (+) strand; PAM type: YTN; PAM sequence: TTC
tagcaactctcctgcctcag

SEQ ID NO: 301203 - DNA, 20 bp, Artificial Sequence
  Description of Artificial Sequence: Synthetic oligonucleotide
  Target: ATXN1; (+) strand; PAM type: YTN; PAM sequence: CTA
gcaactctcctgcctcagcc

SEQ ID NO: 301204 - DNA, 20 bp, Artificial Sequence
  Description of Artificial Sequence: Synthetic oligonucleotide
  Target: ATXN1; (+) strand; PAM type: YTN; PAM sequence: CTC
tcctgcctcagcctcccaag

SEQ ID NO: 301205 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagta

SEQ ID NO: 301206 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 301207 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 301208 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 301209 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgtgccac

SEQ ID NO: 301210 - DNA, 20 bp, Artificial Sequence
  Description of Artificial Sequence: Synthetic oligonucleotide
  Target: ATXN1; (+) strand; PAM type: YTN; PAM sequence: TTA
caggtgtgtgccaccacgcc

SEQ ID NO: 301211 - DNA, 20 bp, Artificial Sequence
  Description of Artificial Sequence: Synthetic oligonucleotide
  Target: ATXN1; (+) strand; PAM type: YTN; PAM sequence: CTA
attttttgtattttagtgga

SEQ ID NO: 301212 - DNA, 20 bp, Artificial Sequence
  Description of Artificial Sequence: Synthetic oligonucleotide
  Target: ATXN1; (+) strand; PAM type: YTN; PAM sequence: TTT
tttgtattttagtggaggtg

SEQ ID NO: 301213 - DNA, 20 bp, Artificial Sequence
  Description of Artificial Sequence: Synthetic oligonucleotide
  Target: ATXN1; (+) strand; PAM type: YTN; PAM sequence: TTT
ttgtattttagtggaggtgg

SEQ ID NO: 301214 - DNA, 20 bp, Artificial Sequence
  Description of Artificial Sequence: Synthetic oligonucleotide
  Target: ATXN1; (+) strand; PAM type: YTN; PAM sequence: TTT
tgtattttagtggaggtggg

SEQ ID NO: 301215 - DNA, 20 bp, Artificial Sequence
  Description of Artificial Sequence: Synthetic oligonucleotide
  Target: ATXN1; (+) strand; PAM type: YTN; PAM sequence: TTT
gtattttagtggaggtgggg

SEQ ID NO: 301216 - DNA, 20 bp, Artificial Sequence
  Description of Artificial Sequence: Synthetic oligonucleotide
  Target: ATXN1; (+) strand; PAM type: YTN; PAM sequence: TTG
tattttagtggaggtggggt

SEQ ID NO: 301217 - DNA, 20 bp, Artificial Sequence
  Description of Artificial Sequence: Synthetic oligonucleotide
  Target: ATXN1; (+) strand; PAM type: YTN; PAM sequence: TTT
tagtggaggtggggtttcac

SEQ ID NO: 301218 - DNA, 20 bp, Artificial Sequence
  Description of Artificial Sequence: Synthetic oligonucleotide
  Target: ATXN1; (+) strand; PAM type: YTN; PAM sequence: TTT
agtggaggtggggtttcacc

SEQ ID NO: 301219 - DNA, 20 bp, Artificial Sequence
  Description of Artificial Sequence: Synthetic oligonucleotide
  Target: ATXN1; (+) strand; PAM type: YTN; PAM sequence: TTA
gtggaggtggggtttcacca

SEQ ID NO: 301220 - DNA, 20 bp, Artificial Sequence
  Description of Artificial Sequence: Synthetic oligonucleotide
  Target: ATXN1; (+) strand; PAM type: YTN; PAM sequence: TTT
caccatgttgcccaggctcg

SEQ ID NO: 301221 - DNA, 20 bp, Artificial Sequence
  Description of Artificial Sequence: Synthetic oligonucleotide
  Target: ATXN1; (+) strand; PAM type: YTN; PAM sequence: TTC
accatgttgcccaggctcgt

SEQ ID NO: 301222 - DNA, 20 bp, Artificial Sequence
  Description of Artificial Sequence: Synthetic oligonucleotide
  Target: ATXN1; (+) strand; PAM type: YTN; PAM sequence: TTG
cccaggctcgtcacaattgt

SEQ ID NO: 301223 - DNA, 20 bp, Artificial Sequence
  Description of Artificial Sequence: Synthetic oligonucleotide
  Target: ATXN1; (+) strand; PAM type: YTN; PAM sequence: CTC
gtcacaattgtcccttcttt

SEQ ID NO: 301224 - DNA, 20 bp, Artificial Sequence
  Description of Artificial Sequence: Synthetic oligonucleotide
  Target: ATXN1; (+) strand; PAM type: YTN; PAM sequence: TTG
tcccttctttaaaagaaatt

SEQ ID NO: 301225 - DNA, 20 bp, Artificial Sequence
  Description of Artificial Sequence: Synthetic oligonucleotide
  Target: ATXN1; (+) strand; PAM type: YTN; PAM sequence: CTT
ctttaaaagaaattatgtct

SEQ ID NO: 301226 - DNA, 20 bp, Artificial Sequence
  Description of Artificial Sequence: Synthetic oligonucleotide
  Target: ATXN1; (+) strand; PAM type: YTN; PAM sequence: TTC
tttaaaagaaattatgtcta

SEQ ID NO: 301227 - DNA, 20 bp, Artificial Sequence
  Description of Artificial Sequence: Synthetic oligonucleotide
  Target: ATXN1; (+) strand; PAM type: YTN; PAM sequence: CTT
taaaagaaattatgtctatg

SEQ ID NO: 301228 - DNA, 20 bp, Artificial Sequence
  Description of Artificial Sequence: Synthetic oligonucleotide
  Target: ATXN1; (+) strand; PAM type: YTN; PAM sequence: TTT
aaaagaaattatgtctatgt

SEQ ID NO: 301229 - DNA, 20 bp, Artificial Sequence
  Description of Artificial Sequence: Synthetic oligonucleotide
  Target: ATXN1; (+) strand; PAM type: YTN; PAM sequence: TTA
aaagaaattatgtctatgtt

SEQ ID NO: 301230 - DNA, 20 bp, Artificial Sequence
  Description of Artificial Sequence: Synthetic oligonucleotide
  Target: ATXN1; (+) strand; PAM type: YTN; PAM sequence: TTA
tgtctatgttaatgaggaac

SEQ ID NO: 301231 - DNA, 20 bp, Artificial Sequence
  Description of Artificial Sequence: Synthetic oligonucleotide
  Target: ATXN1; (+) strand; PAM type: YTN; PAM sequence: CTA
tgttaatgaggaacgtaaca

SEQ ID NO: 301232 - DNA, 20 bp, Artificial Sequence
  Description of Artificial Sequence: Synthetic oligonucleotide
  Target: ATXN1; (+) strand; PAM type: YTN; PAM sequence: TTA
atgaggaacgtaacaaaata

SEQ ID NO: 301233 - DNA, 20 bp, Artificial Sequence
  Description of Artificial Sequence: Synthetic oligonucleotide
  Target: ATXN1; (+) strand; PAM type: YTN; PAM sequence: CTA
aaccgtattatggttgtaaa

SEQ ID NO: 301234 - DNA, 20 bp, Artificial Sequence
  Description of Artificial Sequence: Synthetic oligonucleotide
  Target: ATXN1; (+) strand; PAM type: YTN; PAM sequence: TTA
tggttgtaaaagcacagtta

SEQ ID NO: 301235 - DNA, 20 bp, Artificial Sequence
  Description of Artificial Sequence: Synthetic oligonucleotide
  Target: ATXN1; (+) strand; PAM type: YTN; PAM sequence: TTG
taaaagcacagttatttact

SEQ ID NO: 301236 - DNA, 20 bp, Artificial Sequence
  Description of Artificial Sequence: Synthetic oligonucleotide
  Target: ATXN1; (+) strand; PAM type: YTN; PAM sequence: TTA
tttactttgtttaaattatt

SEQ ID NO: 301237 - DNA, 20 bp, Artificial Sequence
  Description of Artificial Sequence: Synthetic oligonucleotide
  Target: ATXN1; (+) strand; PAM type: YTN; PAM sequence: TTT
actttgtttaaattatttca

SEQ ID NO: 301238 - DNA, 20 bp, Artificial Sequence
  Description of Artificial Sequence: Synthetic oligonucleotide
  Target: ATXN1; (+) strand; PAM type: YTN; PAM sequence: TTA
ctttgtttaaattatttcaa

SEQ ID NO: 301239 - DNA, 20 bp, Artificial Sequence
  Description of Artificial Sequence: Synthetic oligonucleotide
  Target: ATXN1; (+) strand; PAM type: YTN; PAM sequence: CTT
tgtttaaattatttcaacac

SEQ ID NO: 301240 - DNA, 20 bp, Artificial Sequence
  Description of Artificial Sequence: Synthetic oligonucleotide
  Target: ATXN1; (+) strand; PAM type: YTN; PAM sequence: TTT
gtttaaattatttcaacact

SEQ ID NO: 301241 - DNA, 20 bp, Artificial Sequence
  Description of Artificial Sequence: Synthetic oligonucleotide
  Target: ATXN1; (+) strand; PAM type: YTN; PAM sequence: TTG
tttaaattatttcaacactg

SEQ ID NO: 301242 - DNA, 20 bp, Artificial Sequence
  Description of Artificial Sequence: Synthetic oligonucleotide
  Target: ATXN1; (+) strand; PAM type: YTN; PAM sequence: TTT
aaattatttcaacactgtag

SEQ ID NO: 301243 - DNA, 20 bp, Artificial Sequence
  Description of Artificial Sequence: Synthetic oligonucleotide
  Target: ATXN1; (+) strand; PAM type: YTN; PAM sequence: TTA
aattatttcaacactgtaga

SEQ ID NO: 301244 - DNA, 20 bp, Artificial Sequence
  Description of Artificial Sequence: Synthetic oligonucleotide
  Target: ATXN1; (+) strand; PAM type: YTN; PAM sequence: TTA
tttcaacactgtagattatg

SEQ ID NO: 301245 - DNA, 20 bp, Artificial Sequence
  Description of Artificial Sequence: Synthetic oligonucleotide
  Target: ATXN1; (+) strand; PAM type: YTN; PAM sequence: TTT
caacactgtagattatgtta

SEQ ID NO: 301246 - DNA, 20 bp, Artificial Sequence
  Description of Artificial Sequence: Synthetic oligonucleotide
  Target: ATXN1; (+) strand; PAM type: YTN; PAM sequence: TTC
aacactgtagattatgttat

SEQ ID NO: 301247 - DNA, 20 bp, Artificial Sequence
  Description of Artificial Sequence: Synthetic oligonucleotide
  Target: ATXN1; (+) strand; PAM type: YTN; PAM sequence: CTG
tagattatgttatcttttcc

SEQ ID NO: 301248 - DNA, 20 bp, Artificial Sequence
  Description of Artificial Sequence: Synthetic oligonucleotide
  Target: ATXN1; (+) strand; PAM type: YTN; PAM sequence: TTA
tgttatcttttccgattaga

SEQ ID NO: 301249 - DNA, 20 bp, Artificial Sequence
  Description of Artificial Sequence: Synthetic oligonucleotide
  Target: ATXN1; (+) strand; PAM type: YTN; PAM sequence: TTA
tcttttccgattagaaactg

SEQ ID NO: 301250 - DNA, 20 bp, Artificial Sequence
  Description of Artificial Sequence: Synthetic oligonucleotide
  Target: ATXN1; (+) strand; PAM type: YTN; PAM sequence: CTT
ttccgattagaaactgggaa

SEQ ID NO: 301251 - DNA, 20 bp, Artificial Sequence
  Description of Artificial Sequence: Synthetic oligonucleotide
  Target: ATXN1; (+) strand; PAM type: YTN; PAM sequence: TTT
tccgattagaaactgggaaa

SEQ ID NO: 301252 - DNA, 20 bp, Artificial Sequence
  Description of Artificial Sequence: Synthetic oligonucleotide
  Target: ATXN1; (+) strand; PAM type: YTN; PAM sequence: TTT
ccgattagaaactgggaaac

SEQ ID NO: 301253 - DNA, 20 bp, Artificial Sequence
  Description of Artificial Sequence: Synthetic oligonucleotide
  Target: ATXN1; (+) strand; PAM type: YTN; PAM sequence: TTC
cgattagaaactgggaaaca

SEQ ID NO: 301254 - DNA, 20 bp, Artificial Sequence
  Description of Artificial Sequence: Synthetic oligonucleotide
  Target: ATXN1; (+) strand; PAM type: YTN; PAM sequence: TTA
gaaactgggaaacacacgtc

SEQ ID NO: 301255 - DNA, 20 bp, Artificial Sequence
  Description of Artificial Sequence: Synthetic oligonucleotide
  Target: ATXN1; (+) strand; PAM type: YTN; PAM sequence: CTG
ggaaacacacgtcagcctta

SEQ ID NO: 301256 - DNA, 20 bp, Artificial Sequence
  Description of Artificial Sequence: Synthetic oligonucleotide
  Target: ATXN1; (+) strand; PAM type: YTN; PAM sequence: CTT
aaggactacatttcagagct

SEQ ID NO: 301257 - DNA, 20 bp, Artificial Sequence
  Description of Artificial Sequence: Synthetic oligonucleotide
  Target: ATXN1; (+) strand; PAM type: YTN; PAM sequence: TTA
aggactacatttcagagctg

SEQ ID NO: 301258 - DNA, 20 bp, Artificial Sequence
  Description of Artificial Sequence: Synthetic oligonucleotide
  Target: ATXN1; (+) strand; PAM type: YTN; PAM sequence: CTA
catttcagagctgagagaga

SEQ ID NO: 301259 - DNA, 20 bp, Artificial Sequence
  Description of Artificial Sequence: Synthetic oligonucleotide
  Target: ATXN1; (+) strand; PAM type: YTN; PAM sequence: TTT
cagagctgagagagaaacaa

SEQ ID NO: 301260 - DNA, 20 bp, Artificial Sequence
  Description of Artificial Sequence: Synthetic oligonucleotide
  Target: ATXN1; (+) strand; PAM type: YTN; PAM sequence: TTC
agagctgagagagaaacaag

SEQ ID NO: 301261 - DNA, 20 bp, Artificial Sequence
  Description of Artificial Sequence: Synthetic oligonucleotide
  Target: ATXN1; (+) strand; PAM type: YTN; PAM sequence: CTG
agagagaaacaagtggtcgt

SEQ ID NO: 301262 - DNA, 20 bp, Artificial Sequence
  Description of Artificial Sequence: Synthetic oligonucleotide
  Target: ATXN1; (+) strand; PAM type: YTN; PAM sequence: CTA
caataaccttctatccaact

SEQ ID NO: 301263 - DNA, 20 bp, Artificial Sequence
  Description of Artificial Sequence: Synthetic oligonucleotide
  Target: ATXN1; (+) strand; PAM type: YTN; PAM sequence: CTT
ctatccaactcacatctcct

SEQ ID NO: 301264 - DNA, 20 bp, Artificial Sequence
  Description of Artificial Sequence: Synthetic oligonucleotide
  Target: ATXN1; (+) strand; PAM type: YTN; PAM sequence: TTC
tatccaactcacatctcctc

SEQ ID NO: 301265 - DNA, 20 bp, Artificial Sequence
  Description of Artificial Sequence: Synthetic oligonucleotide
  Target: ATXN1; (+) strand; PAM type: YTN; PAM sequence: CTA
tccaactcacatctcctctc

SEQ ID NO: 301266 - DNA, 20 bp, Artificial Sequence
  Description of Artificial Sequence: Synthetic oligonucleotide
  Target: ATXN1; (+) strand; PAM type: YTN; PAM sequence: CTC
acatctcctctctggagaat

SEQ ID NO: 301267 - DNA, 20 bp, Artificial Sequence
  Description of Artificial Sequence: Synthetic oligonucleotide
  Target: ATXN1; (+) strand; PAM type: YTN; PAM sequence: CTC
ctctctggagaattcctgat

SEQ ID NO: 301268 - DNA, 20 bp, Artificial Sequence
  Description of Artificial Sequence: Synthetic oligonucleotide
  Target: ATXN1; (+) strand; PAM type: YTN; PAM sequence: CTC
tctggagaattcctgataag

SEQ ID NO: 301269 - DNA, 20 bp, Artificial Sequence
  Description of Artificial Sequence: Synthetic oligonucleotide
  Target: ATXN1; (+) strand; PAM type: YTN; PAM sequence: CTC
tggagaattcctgataagag

SEQ ID NO: 301270 - DNA, 20 bp, Artificial Sequence
  Description of Artificial Sequence: Synthetic oligonucleotide
  Target: ATXN1; (+) strand; PAM type: YTN; PAM sequence: CTG
gagaattcctgataagaggg

SEQ ID NO: 301271 - DNA, 20 bp, Artificial Sequence
  Description of Artificial Sequence: Synthetic oligonucleotide
  Target: ATXN1; (+) strand; PAM type: YTN; PAM sequence: TTC
ctgataagagggtcctacta

SEQ ID NO: 301272 - DNA, 20 bp, Artificial Sequence
  Description of Artificial Sequence: Synthetic oligonucleotide
  Target: ATXN1; (+) strand; PAM type: YTN; PAM sequence: CTG
ataagagggtcctactacct

SEQ ID NO: 301273 - DNA, 20 bp, Artificial Sequence
  Description of Artificial Sequence: Synthetic oligonucleotide
  Target: ATXN1; (+) strand; PAM type: YTN; PAM sequence: CTA
ctacctctgtttgaacatct

SEQ ID NO: 301274 - DNA, 20 bp, Artificial Sequence
  Description of Artificial Sequence: Synthetic oligonucleotide
  Target: ATXN1; (+) strand; PAM type: YTN; PAM sequence: CTA
cctctgtttgaacatctcca

SEQ ID NO: 301275 - DNA, 20 bp, Artificial Sequence
  Description of Artificial Sequence: Synthetic oligonucleotide
  Target: ATXN1; (+) strand; PAM type: YTN; PAM sequence: CTC
tgtttgaacatctccagtga

SEQ ID NO: 301276 - DNA, 20 bp, Artificial Sequence
  Description of Artificial Sequence: Synthetic oligonucleotide
  Target: ATXN1; (+) strand; PAM type: YTN; PAM sequence: CTG
tttgaacatctccagtgaca

SEQ ID NO: 301277 - DNA, 20 bp, Artificial Sequence
  Description of Artificial Sequence: Synthetic oligonucleotide
  Target: ATXN1; (+) strand; PAM type: YTN; PAM sequence: TTT
gaacatctccagtgacagag

SEQ ID NO: 301278 - DNA, 20 bp, Artificial Sequence
  Description of Artificial Sequence: Synthetic oligonucleotide
  Target: ATXN1; (+) strand; PAM type: YTN; PAM sequence: TTG
aacatctccagtgacagagg

SEQ ID NO: 301279 - DNA, 20 bp, Artificial Sequence
  Description of Artificial Sequence: Synthetic oligonucleotide
  Target: ATXN1; (+) strand; PAM type: YTN; PAM sequence: CTC
cagtgacagaggtttcactg

SEQ ID NO: 301280 - DNA, 20 bp, Artificial Sequence
  Description of Artificial Sequence: Synthetic oligonucleotide
  Target: ATXN1; (+) strand; PAM type: YTN; PAM sequence: TTT
cactgctaaatcaatcagct

SEQ ID NO: 301281 - DNA, 20 bp, Artificial Sequence
  Description of Artificial Sequence: Synthetic oligonucleotide
  Target: ATXN1; (+) strand; PAM type: YTN; PAM sequence: TTC
actgctaaatcaatcagctt

SEQ ID NO: 301282 - DNA, 20 bp, Artificial Sequence
  Description of Artificial Sequence: Synthetic oligonucleotide
  Target: ATXN1; (+) strand; PAM type: YTN; PAM sequence: CTG
ctaaatcaatcagcttgttc

SEQ ID NO: 301283 - DNA, 20 bp, Artificial Sequence
  Description of Artificial Sequence: Synthetic oligonucleotide
  Target: ATXN1; (+) strand; PAM type: YTN; PAM sequence: CTA
aatcaatcagcttgttccat

SEQ ID NO: 301284 - DNA, 20 bp, Artificial Sequence
  Description of Artificial Sequence: Synthetic oligonucleotide
  Target: ATXN1; (+) strand; PAM type: YTN; PAM sequence: CTT
gttccatttttagacagtcc

SEQ ID NO: 301285 - DNA, 20 bp, Artificial Sequence
  Description of Artificial Sequence: Synthetic oligonucleotide
  Target: ATXN1; (+) strand; PAM type: YTN; PAM sequence: TTG
ttccatttttagacagtcct

SEQ ID NO: 301286 - DNA, 20 bp, Artificial Sequence
  Description of Artificial Sequence: Synthetic oligonucleotide
  Target: ATXN1; (+) strand; PAM type: YTN; PAM sequence: TTC
catttttagacagtcctgat

SEQ ID NO: 301287 - DNA, 20 bp, Artificial Sequence
  Description of Artificial Sequence: Synthetic oligonucleotide
  Target: ATXN1; (+) strand; PAM type: YTN; PAM sequence: TTT
ttagacagtcctgattgcca

SEQ ID NO: 301288 - DNA, 20 bp, Artificial Sequence
  Description of Artificial Sequence: Synthetic oligonucleotide
  Target: ATXN1; (+) strand; PAM type: YTN; PAM sequence: TTT
tagacagtcctgattgccag

SEQ ID NO: 301289 - DNA, 20 bp, Artificial Sequence
  Description of Artificial Sequence: Synthetic oligonucleotide
  Target: ATXN1; (+) strand; PAM type: YTN; PAM sequence: TTT
agacagtcctgattgccaga

SEQ ID NO: 301290 - DNA, 20 bp, Artificial Sequence
  Description of Artificial Sequence: Synthetic oligonucleotide
  Target: ATXN1; (+) strand; PAM type: YTN; PAM sequence: TTA
gacagtcctgattgccagaa

SEQ ID NO: 301291 - DNA, 20 bp, Artificial Sequence
  Description of Artificial Sequence: Synthetic oligonucleotide
  Target: ATXN1; (+) strand; PAM type: YTN; PAM sequence: CTG
attgccagaatgttcctcct

SEQ ID NO: 301292 - DNA, 20 bp, Artificial Sequence
  Description of Artificial Sequence: Synthetic oligonucleotide
  Target: ATXN1; (+) strand; PAM type: YTN; PAM sequence: TTG
ccagaatgttcctcctcaag

SEQ ID NO: 301293 - DNA, 20 bp, Artificial Sequence
  Description of Artificial Sequence: Synthetic oligonucleotide
  Target: ATXN1; (+) strand; PAM type: YTN; PAM sequence: TTC
ctcctcaagtggagtcgaac

SEQ ID NO: 301294 - DNA, 20 bp, Artificial Sequence
  Description of Artificial Sequence: Synthetic oligonucleotide
  Target: ATXN1; (+) strand; PAM type: YTN; PAM sequence: CTC
ctcaagtggagtcgaactct

SEQ ID NO: 301295 - DNA, 20 bp, Artificial Sequence
  Description of Artificial Sequence: Synthetic oligonucleotide
  Target: ATXN1; (+) strand; PAM type: YTN; PAM sequence: CTC
aagtggagtcgaactctccc

SEQ ID NO: 301296 - DNA, 20 bp, Artificial Sequence
  Description of Artificial Sequence: Synthetic oligonucleotide
  Target: ATXN1; (+) strand; PAM type: YTN; PAM sequence: CTC
tccctagggttaacttccct

SEQ ID NO: 301297 - DNA, 20 bp, Artificial Sequence
  Description of Artificial Sequence: Synthetic oligonucleotide
  Target: ATXN1; (+) strand; PAM type: YTN; PAM sequence: CTC
cctagggttaacttccctcc

SEQ ID NO: 301298 - DNA, 20 bp, Artificial Sequence
  Description of Artificial Sequence: Synthetic oligonucleotide
  Target: ATXN1; (+) strand; PAM type: YTN; PAM sequence: CTA
gggttaacttccctcctgtt

SEQ ID NO: 301299 - DNA, 20 bp, Artificial Sequence
  Description of Artificial Sequence: Synthetic oligonucleotide
  Target: ATXN1; (+) strand; PAM type: YTN; PAM sequence: TTA
acttccctcctgttcttagt

SEQ ID NO: 301300 - DNA, 20 bp, Artificial Sequence
  Description of Artificial Sequence: Synthetic oligonucleotide
  Target: ATXN1; (+) strand; PAM type: YTN; PAM sequence: CTT
ccctcctgttcttagttctt

SEQ ID NO: 301301 - DNA, 20 bp, Artificial Sequence
  Description of Artificial Sequence: Synthetic oligonucleotide
  Target: ATXN1; (+) strand; PAM type: YTN; PAM sequence: TTC
cctcctgttcttagttcttg

SEQ ID NO: 301302 - DNA, 20 bp, Artificial Sequence
  Description of Artificial Sequence: Synthetic oligonucleotide
  Target: ATXN1; (+) strand; PAM type: YTN; PAM sequence: CTC
ctgttcttagttcttggttg

SEQ ID NO: 301303 - DNA, 20 bp, Artificial Sequence
  Description of Artificial Sequence: Synthetic oligonucleotide
  Target: ATXN1; (+) strand; PAM type: YTN; PAM sequence: CTG
ttcttagttcttggttgcgt

SEQ ID NO: 301304 - DNA, 20 bp, Artificial Sequence
  Description of Artificial Sequence: Synthetic oligonucleotide
  Target: ATXN1; (+) strand; PAM type: YTN; PAM sequence: TTC
ttagttcttggttgcgtact

SEQ ID NO: 301305 - DNA, 20 bp, Artificial Sequence
  Description of Artificial Sequence: Synthetic oligonucleotide
  Target: ATXN1; (+) strand; PAM type: YTN; PAM sequence: CTT
agttcttggttgcgtactct

SEQ ID NO: 301306 - DNA, 20 bp, Artificial Sequence
  Description of Artificial Sequence: Synthetic oligonucleotide
  Target: ATXN1; (+) strand; PAM type: YTN; PAM sequence: TTA
gttcttggttgcgtactcta

SEQ ID NO: 301307 - DNA, 20 bp, Artificial Sequence
  Description of Artificial Sequence: Synthetic oligonucleotide
  Target: ATXN1; (+) strand; PAM type: YTN; PAM sequence: TTC
ttggttgcgtactctaccac

SEQ ID NO: 301308 - DNA, 20 bp, Artificial Sequence
  Description of Artificial Sequence: Synthetic oligonucleotide
  Target: ATXN1; (+) strand; PAM type: YTN; PAM sequence: CTT
ggttgcgtactctaccacca

SEQ ID NO: 301309 - DNA, 20 bp, Artificial Sequence
  Description of Artificial Sequence: Synthetic oligonucleotide
  Target: ATXN1; (+) strand; PAM type: YTN; PAM sequence: TTG
gttgcgtactctaccaccac

SEQ ID NO: 301310 - DNA, 20 bp, Artificial Sequence
  Description of Artificial Sequence: Synthetic oligonucleotide
  Target: ATXN1; (+) strand; PAM type: YTN; PAM sequence: TTG
cgtactctaccaccacttca

SEQ ID NO: 301311 - DNA, 20 bp, Artificial Sequence
  Description of Artificial Sequence: Synthetic oligonucleotide
  Target: ATXN1; (+) strand; PAM type: YTN; PAM sequence: CTC
taccaccacttcagtaagtg

SEQ ID NO: 301312 - DNA, 20 bp, Artificial Sequence
  Description of Artificial Sequence: Synthetic oligonucleotide
  Target: ATXN1; (+) strand; PAM type: YTN; PAM sequence: CTA
ccaccacttcagtaagtgat

SEQ ID NO: 301313 - DNA, 20 bp, Artificial Sequence
  Description of Artificial Sequence: Synthetic oligonucleotide
  Target: ATXN1; (+) strand; PAM type: YTN; PAM sequence: CTT
cagtaagtgatttcacttcc

SEQ ID NO: 301314 - DNA, 20 bp, Artificial Sequence
  Description of Artificial Sequence: Synthetic oligonucleotide
  Target: ATXN1; (+) strand; PAM type: YTN; PAM sequence: TTC
agtaagtgatttcacttcct

SEQ ID NO: 301315 - DNA, 20 bp, Artificial Sequence
  Description of Artificial Sequence: Synthetic oligonucleotide
  Target: ATXN1; (+) strand; PAM type: YTN; PAM sequence: TTT
cacttcctgtcaggcccttt

SEQ ID NO: 301316 - DNA, 20 bp, Artificial Sequence
  Description of Artificial Sequence: Synthetic oligonucleotide
  Target: ATXN1; (+) strand; PAM type: YTN; PAM sequence: TTC
acttcctgtcaggccctttg

SEQ ID NO: 301317 - DNA, 20 bp, Artificial Sequence
  Description of Artificial Sequence: Synthetic oligonucleotide
  Target: ATXN1; (+) strand; PAM type: YTN; PAM sequence: CTT
cctgtcaggccctttgctag

SEQ ID NO: 301318 - DNA, 20 bp, Artificial Sequence
  Description of Artificial Sequence: Synthetic oligonucleotide
  Target: ATXN1; (+) strand; PAM type: YTN; PAM sequence: TTC
ctgtcaggccctttgctagc

SEQ ID NO: 301319 - DNA, 20 bp, Artificial Sequence
  Description of Artificial Sequence: Synthetic oligonucleotide
  Target: ATXN1; (+) strand; PAM type: YTN; PAM sequence: CTG
tcaggccctttgctagcctc

SEQ ID NO: 301320 - DNA, 20 bp, Artificial Sequence
  Description of Artificial Sequence: Synthetic oligonucleotide
  Target: ATXN1; (+) strand; PAM type: YTN; PAM sequence: CTT
tgctagcctcactcatttta

SEQ ID NO: 301321 - DNA, 20 bp, Artificial Sequence
  Description of Artificial Sequence: Synthetic oligonucleotide
  Target: ATXN1; (+) strand; PAM type: YTN; PAM sequence: TTT
gctagcctcactcattttat

SEQ ID NO: 301322 - DNA, 20 bp, Artificial Sequence
  Description of Artificial Sequence: Synthetic oligonucleotide
  Target: ATXN1; (+) strand; PAM type: YTN; PAM sequence: TTG
ctagcctcactcattttatc

SEQ ID NO: 301323 - DNA, 20 bp, Artificial Sequence
  Description of Artificial Sequence: Synthetic oligonucleotide
  Target: ATXN1; (+) strand; PAM type: YTN; PAM sequence: CTA
gcctcactcattttatcagt

SEQ ID NO: 301324 - DNA, 20 bp, Artificial Sequence
  Description of Artificial Sequence: Synthetic oligonucleotide
  Target: ATXN1; (+) strand; PAM type: YTN; PAM sequence: CTC
actcattttatcagttaggt

SEQ ID NO: 301325 - DNA, 20 bp, Artificial Sequence
  Description of Artificial Sequence: Synthetic oligonucleotide
  Target: ATXN1; (+) strand; PAM type: YTN; PAM sequence: CTC
attttatcagttaggtaatg

SEQ ID NO: 301326 - DNA, 20 bp, Artificial Sequence
  Description of Artificial Sequence: Synthetic oligonucleotide
  Target: ATXN1; (+) strand; PAM type: YTN; PAM sequence: TTT
tatcagttaggtaatgactg

SEQ ID NO: 301327 - DNA, 20 bp, Artificial Sequence
  Description of Artificial Sequence: Synthetic oligonucleotide
  Target: ATXN1; (+) strand; PAM type: YTN; PAM sequence: TTT
atcagttaggtaatgactgg

SEQ ID NO: 301328 - DNA, 20 bp, Artificial Sequence
  Description of Artificial Sequence: Synthetic oligonucleotide
  Target: ATXN1; (+) strand; PAM type: YTN; PAM sequence: TTA
tcagttaggtaatgactggc

SEQ ID NO: 301329 - DNA, 20 bp, Artificial Sequence
  Description of Artificial Sequence: Synthetic oligonucleotide
  Target: ATXN1; (+) strand; PAM type: YTN; PAM sequence: TTA
ggtaatgactggcttctatt

SEQ ID NO: 301330 - DNA, 20 bp, Artificial Sequence
  Description of Artificial Sequence: Synthetic oligonucleotide
  Target: ATXN1; (+) strand; PAM type: YTN; PAM sequence: CTG
gcttctattcacaattgtca

SEQ ID NO: 301331 - DNA, 20 bp, Artificial Sequence
  Description of Artificial Sequence: Synthetic oligonucleotide
  Target: ATXN1; (+) strand; PAM type: YTN; PAM sequence: CTT
ctattcacaattgtcactgt

SEQ ID NO: 301332 - DNA, 20 bp, Artificial Sequence
  Description of Artificial Sequence: Synthetic oligonucleotide
  Target: ATXN1; (+) strand; PAM type: YTN; PAM sequence: TTC
tattcacaattgtcactgtt

SEQ ID NO: 301333 - DNA, 20 bp, Artificial Sequence
  Description of Artificial Sequence: Synthetic oligonucleotide
  Target: ATXN1; (+) strand; PAM type: YTN; PAM sequence: CTA
ttcacaattgtcactgttat

SEQ ID NO: 301334 - DNA, 20 bp, Artificial Sequence
  Description of Artificial Sequence: Synthetic oligonucleotide
  Target: ATXN1; (+) strand; PAM type: YTN; PAM sequence: TTC
acaattgtcactgttattct

SEQ ID NO: 301335 - DNA, 20 bp, Artificial Sequence
  Description of Artificial Sequence: Synthetic oligonucleotide
  Target: ATXN1; (+) strand; PAM type: YTN; PAM sequence: TTG
tcactgttattctgtgaacc

SEQ ID NO: 301336 - DNA, 20 bp, Artificial Sequence
  Description of Artificial Sequence: Synthetic oligonucleotide
  Target: ATXN1; (+) strand; PAM type: YTN; PAM sequence: CTG
ttattctgtgaaccacagtg

SEQ ID NO: 301337 - DNA, 20 bp, Artificial Sequence
  Description of Artificial Sequence: Synthetic oligonucleotide
  Target: ATXN1; (+) strand; PAM type: YTN; PAM sequence: TTA
ttctgtgaaccacagtgacc

SEQ ID NO: 301338 - DNA, 20 bp, Artificial Sequence
  Description of Artificial Sequence: Synthetic oligonucleotide
  Target: ATXN1; (+) strand; PAM type: YTN; PAM sequence: TTC
tgtgaaccacagtgaccatt

SEQ ID NO: 301339 - DNA, 20 bp, Artificial Sequence
  Description of Artificial Sequence: Synthetic oligonucleotide
  Target: ATXN1; (+) strand; PAM type: YTN; PAM sequence: CTG
tgaaccacagtgaccattct

SEQ ID NO: 301340 - DNA, 20 bp, Artificial Sequence
  Description of Artificial Sequence: Synthetic oligonucleotide
  Target: ATXN1; (+) strand; PAM type: YTN; PAM sequence: TTC
ttcacaaccacctaccaccc

SEQ ID NO: 301341 - DNA, 20 bp, Artificial Sequence
  Description of Artificial Sequence: Synthetic oligonucleotide
  Target: ATXN1; (+) strand; PAM type: YTN; PAM sequence: CTT
cacaaccacctaccacccac

SEQ ID NO: 301342 - DNA, 20 bp, Artificial Sequence
  Description of Artificial Sequence: Synthetic oligonucleotide
  Target: ATXN1; (+) strand; PAM type: YTN; PAM sequence: TTC
acaaccacctaccacccact

SEQ ID NO: 301343 - DNA, 20 bp, Artificial Sequence
  Description of Artificial Sequence: Synthetic oligonucleotide
  Target: ATXN1; (+) strand; PAM type: YTN; PAM sequence: CTA
ccacccactgaagtggtggc

SEQ ID NO: 301344 - DNA, 20 bp, Artificial Sequence
  Description of Artificial Sequence: Synthetic oligonucleotide
  Target: ATXN1; (+) strand; PAM type: YTN; PAM sequence: CTG
aagtggtggctcttgggcac

SEQ ID NO: 301345 - DNA, 20 bp, Artificial Sequence
  Description of Artificial Sequence: Synthetic oligonucleotide
  Target: ATXN1; (+) strand; PAM type: YTN; PAM sequence: CTC
ttgggcaccatggctcttgg

SEQ ID NO: 301346 - DNA, 20 bp, Artificial Sequence
  Description of Artificial Sequence: Synthetic oligonucleotide
  Target: ATXN1; (+) strand; PAM type: YTN; PAM sequence: CTT
gggcaccatggctcttgggg

SEQ ID NO: 301347 - DNA, 20 bp, Artificial Sequence
  Description of Artificial Sequence: Synthetic oligonucleotide
  Target: ATXN1; (+) strand; PAM type: YTN; PAM sequence: TTG
ggcaccatggctcttgggga

SEQ ID NO: 301348 - DNA, 20 bp, Artificial Sequence
  Description of Artificial Sequence: Synthetic oligonucleotide
  Target: ATXN1; (+) strand; PAM type: YTN; PAM sequence: CTC
ttggggaccatggctctatg

SEQ ID NO: 301349 - DNA, 20 bp, Artificial Sequence
  Description of Artificial Sequence: Synthetic oligonucleotide
  Target: ATXN1; (+) strand; PAM type: YTN; PAM sequence: CTT
ggggaccatggctctatgga

SEQ ID NO: 301350 - DNA, 20 bp, Artificial Sequence
  Description of Artificial Sequence: Synthetic oligonucleotide
  Target: ATXN1; (+) strand; PAM type: YTN; PAM sequence: TTG
gggaccatggctctatggag

SEQ ID NO: 301351 - DNA, 20 bp, Artificial Sequence
  Description of Artificial Sequence: Synthetic oligonucleotide
  Target: ATXN1; (+) strand; PAM type: YTN; PAM sequence: CTC
tatggagactatgatgggca

SEQ ID NO: 301352 - DNA, 20 bp, Artificial Sequence
  Description of Artificial Sequence: Synthetic oligonucleotide
  Target: ATXN1; (+) strand; PAM type: YTN; PAM sequence: CTA
tggagactatgatgggcatg

SEQ ID NO: 301353 - DNA, 20 bp, Artificial Sequence
  Description of Artificial Sequence: Synthetic oligonucleotide
  Target: ATXN1; (+) strand; PAM type: YTN; PAM sequence: CTA
tgatgggcatggtcctaagg

SEQ ID NO: 301354 - DNA, 20 bp, Artificial Sequence
  Description of Artificial Sequence: Synthetic oligonucleotide
  Target: ATXN1; (+) strand; PAM type: YTN; PAM sequence: CTA
aggccattatgggatatttt

SEQ ID NO: 301355 - DNA, 20 bp, Artificial Sequence
  Description of Artificial Sequence: Synthetic oligonucleotide
  Target: ATXN1; (+) strand; PAM type: YTN; PAM sequence: TTA
tgggatattttggactttac

SEQ ID NO: 301356 - DNA, 20 bp, Artificial Sequence
  Description of Artificial Sequence: Synthetic oligonucleotide
  Target: ATXN1; (+) strand; PAM type: YTN; PAM sequence: TTT
tggactttactggggtcctg

SEQ ID NO: 301357 - DNA, 20 bp, Artificial Sequence
  Description of Artificial Sequence: Synthetic oligonucleotide
  Target: ATXN1; (+) strand; PAM type: YTN; PAM sequence: TTT
ggactttactggggtcctgc

SEQ ID NO: 301358 - DNA, 20 bp, Artificial Sequence
  Description of Artificial Sequence: Synthetic oligonucleotide
  Target: ATXN1; (+) strand; PAM type: YTN; PAM sequence: TTG
gactttactggggtcctgcc

SEQ ID NO: 301359 - DNA, 20 bp, Artificial Sequence
  Description of Artificial Sequence: Synthetic oligonucleotide
  Target: ATXN1; (+) strand; PAM type: YTN; PAM sequence: CTT
tactggggtcctgccatcac

SEQ ID NO: 301360 - DNA, 20 bp, Artificial Sequence
  Description of Artificial Sequence: Synthetic oligonucleotide
  Target: ATXN1; (+) strand; PAM type: YTN; PAM sequence: TTT
actggggtcctgccatcaca

SEQ ID NO: 301361 - DNA, 20 bp, Artificial Sequence
  Description of Artificial Sequence: Synthetic oligonucleotide
  Target: ATXN1; (+) strand; PAM type: YTN; PAM sequence: TTA
ctggggtcctgccatcacat

SEQ ID NO: 301362 - DNA, 20 bp, Artificial Sequence
  Description of Artificial Sequence: Synthetic oligonucleotide
  Target: ATXN1; (+) strand; PAM type: YTN; PAM sequence: CTG
gggtcctgccatcacataca

SEQ ID NO: 301363 - DNA, 20 bp, Artificial Sequence
  Description of Artificial Sequence: Synthetic oligonucleotide
  Target: ATXN1; (+) strand; PAM type: YTN; PAM sequence: CTG
ccatcacatacactgtttct

SEQ ID NO: 301364 - DNA, 20 bp, Artificial Sequence
  Description of Artificial Sequence: Synthetic oligonucleotide
  Target: ATXN1; (+) strand; PAM type: YTN; PAM sequence: CTG
tttctctgagaaacttagac

SEQ ID NO: 301365 - DNA, 20 bp, Artificial Sequence
  Description of Artificial Sequence: Synthetic oligonucleotide
  Target: ATXN1; (+) strand; PAM type: YTN; PAM sequence: TTT
ctctgagaaacttagactta

SEQ ID NO: 301366 - DNA, 20 bp, Artificial Sequence
  Description of Artificial Sequence: Synthetic oligonucleotide
  Target: ATXN1; (+) strand; PAM type: YTN; PAM sequence: TTC
tctgagaaacttagacttac

SEQ ID NO: 301367 - DNA, 20 bp, Artificial Sequence
  Description of Artificial Sequence: Synthetic oligonucleotide
  Target: ATXN1; (+) strand; PAM type: YTN; PAM sequence: CTC
tgagaaacttagacttacaa

SEQ ID NO: 301368 - DNA, 20 bp, Artificial Sequence
  Description of Artificial Sequence: Synthetic oligonucleotide
  Target: ATXN1; (+) strand; PAM type: YTN; PAM sequence: CTG
agaaacttagacttacaatc

SEQ ID NO: 301369 - DNA, 20 bp, Artificial Sequence
  Description of Artificial Sequence: Synthetic oligonucleotide
  Target: ATXN1; (+) strand; PAM type: YTN; PAM sequence: CTT
agacttacaatctttctgaa

SEQ ID NO: 301370 - DNA, 20 bp, Artificial Sequence
  Description of Artificial Sequence: Synthetic oligonucleotide
  Target: ATXN1; (+) strand; PAM type: YTN; PAM sequence: TTA
gacttacaatctttctgaaa

SEQ ID NO: 301371 - DNA, 20 bp, Artificial Sequence
  Description of Artificial Sequence: Synthetic oligonucleotide
  Target: ATXN1; (+) strand; PAM type: YTN; PAM sequence: CTT
acaatctttctgaaaaggat

SEQ ID NO: 301372 - DNA, 20 bp, Artificial Sequence
  Description of Artificial Sequence: Synthetic oligonucleotide
  Target: ATXN1; (+) strand; PAM type: YTN; PAM sequence: TTA
caatctttctgaaaaggata

SEQ ID NO: 301373 - DNA, 20 bp, Artificial Sequence
  Description of Artificial Sequence: Synthetic oligonucleotide
  Target: ATXN1; (+) strand; PAM type: YTN; PAM sequence: CTT
tctgaaaaggatacattata

SEQ ID NO: 301374 - DNA, 20 bp, Artificial Sequence
  Description of Artificial Sequence: Synthetic oligonucleotide
  Target: ATXN1; (+) strand; PAM type: YTN; PAM sequence: TTT
ctgaaaaggatacattataa

SEQ ID NO: 301375 - DNA, 20 bp, Artificial Sequence
  Description of Artificial Sequence: Synthetic oligonucleotide
  Target: ATXN1; (+) strand; PAM type: YTN; PAM sequence: TTC
tgaaaaggatacattataaa

SEQ ID NO: 301376 - DNA, 20 bp, Artificial Sequence
  Description of Artificial Sequence: Synthetic oligonucleotide
  Target: ATXN1; (+) strand; PAM type: YTN; PAM sequence: CTG
aaaaggatacattataaatt

SEQ ID NO: 301377 - DNA, 20 bp, Artificial Sequence
  Description of Artificial Sequence: Synthetic oligonucleotide
  Target: ATXN1; (+) strand; PAM type: YTN; PAM sequence: TTA
taaattagtatttctacttt

SEQ ID NO: 301378 - DNA, 20 bp, Artificial Sequence
  Description of Artificial Sequence: Synthetic oligonucleotide
  Target: ATXN1; (+) strand; PAM type: YTN; PAM sequence: TTA
gtatttctacttttgggaaa

SEQ ID NO: 301379 - DNA, 20 bp, Artificial Sequence
  Description of Artificial Sequence: Synthetic oligonucleotide
  Target: ATXN1; (+) strand; PAM type: YTN; PAM sequence: TTT
ctacttttgggaaaaatctg

SEQ ID NO: 301380 - DNA, 20 bp, Artificial Sequence
  Description of Artificial Sequence: Synthetic oligonucleotide
  Target: ATXN1; (+) strand; PAM type: YTN; PAM sequence: TTC
tacttttgggaaaaatctgt

SEQ ID NO: 301381 - DNA, 20 bp, Artificial Sequence
  Description of Artificial Sequence: Synthetic oligonucleotide
  Target: ATXN1; (+) strand; PAM type: YTN; PAM sequence: CTA
cttttgggaaaaatctgttt

SEQ ID NO: 301382 - DNA, 20 bp, Artificial Sequence
  Description of Artificial Sequence: Synthetic oligonucleotide
  Target: ATXN1; (+) strand; PAM type: YTN; PAM sequence: CTT
ttgggaaaaatctgtttcat

SEQ ID NO: 301383 - DNA, 20 bp, Artificial Sequence
  Description of Artificial Sequence: Synthetic oligonucleotide
  Target: ATXN1; (+) strand; PAM type: YTN; PAM sequence: TTT
tgggaaaaatctgtttcatg

SEQ ID NO: 301384 - DNA, 20 bp, Artificial Sequence
  Description of Artificial Sequence: Synthetic oligonucleotide
  Target: ATXN1; (+) strand; PAM type: YTN; PAM sequence: TTT
gggaaaaatctgtttcatga

SEQ ID NO: 301385 - DNA, 20 bp, Artificial Sequence
  Description of Artificial Sequence: Synthetic oligonucleotide
  Target: ATXN1; (+) strand; PAM type: YTN; PAM sequence: TTG
ggaaaaatctgtttcatgag

SEQ ID NO: 301386 - DNA, 20 bp, Artificial Sequence
  Description of Artificial Sequence: Synthetic oligonucleotide
  Target: ATXN1; (+) strand; PAM type: YTN; PAM sequence: CTG
tttcatgagaaacaaggcgt

SEQ ID NO: 301387 - DNA, 20 bp, Artificial Sequence
  Description of Artificial Sequence: Synthetic oligonucleotide
  Target: ATXN1; (+) strand; PAM type: YTN; PAM sequence: TTT
catgagaaacaaggcgtaat

SEQ ID NO: 301388 - DNA, 20 bp, Artificial Sequence
  Description of Artificial Sequence: Synthetic oligonucleotide
  Target: ATXN1; (+) strand; PAM type: YTN; PAM sequence: TTC
atgagaaacaaggcgtaatt

SEQ ID NO: 301389 - DNA, 20 bp, Artificial Sequence
  Description of Artificial Sequence: Synthetic oligonucleotide
  Target: ATXN1; (+) strand; PAM type: YTN; PAM sequence: TTT
atcactctgtcttttaagca

SEQ ID NO: 301390 - DNA, 20 bp, Artificial Sequence
  Description of Artificial Sequence: Synthetic oligonucleotide
  Target: ATXN1; (+) strand; PAM type: YTN; PAM sequence: TTA
tcactctgtcttttaagcag

SEQ ID NO: 301391 - DNA, 20 bp, Artificial Sequence
  Description of Artificial Sequence: Synthetic oligonucleotide
  Target: ATXN1; (+) strand; PAM type: YTN; PAM sequence: CTC
tgtcttttaagcagtcttat

SEQ ID NO: 301392 - DNA, 20 bp, Artificial Sequence
  Description of Artificial Sequence: Synthetic oligonucleotide
  Target: ATXN1; (+) strand; PAM type: YTN; PAM sequence: CTG
tcttttaagcagtcttatga

SEQ ID NO: 301393 - DNA, 20 bp, Artificial Sequence
  Description of Artificial Sequence: Synthetic oligonucleotide
  Target: ATXN1; (+) strand; PAM type: YTN; PAM sequence: CTT
ttaagcagtcttatgagcca

SEQ ID NO: 301394 - DNA, 20 bp, Artificial Sequence
  Description of Artificial Sequence: Synthetic oligonucleotide
  Target: ATXN1; (+) strand; PAM type: YTN; PAM sequence: TTT
taagcagtcttatgagccaa

SEQ ID NO: 301395 - DNA, 20 bp, Artificial Sequence
  Description of Artificial Sequence: Synthetic oligonucleotide
  Target: ATXN1; (+) strand; PAM type: YTN; PAM sequence: TTT
aagcagtcttatgagccaag

SEQ ID NO: 301396 - DNA, 20 bp, Artificial Sequence
  Description of Artificial Sequence: Synthetic oligonucleotide
  Target: ATXN1; (+) strand; PAM type: YTN; PAM sequence: TTA
agcagtcttatgagccaagt

SEQ ID NO: 301397 - DNA, 20 bp, Artificial Sequence
  Description of Artificial Sequence: Synthetic oligonucleotide
  Target: ATXN1; (+) strand; PAM type: YTN; PAM sequence: CTT
atgagccaagtcagtgtttt

SEQ ID NO: 301398 - DNA, 20 bp, Artificial Sequence
  Description of Artificial Sequence: Synthetic oligonucleotide
  Target: ATXN1; (+) strand; PAM type: YTN; PAM sequence: TTA
tgagccaagtcagtgttttg

SEQ ID NO: 301399 - DNA, 20 bp, Artificial Sequence
  Description of Artificial Sequence: Synthetic oligonucleotide
  Target: ATXN1; (+) strand; PAM type: YTN; PAM sequence: TTT
tgatgcatgcataaaaattc

SEQ ID NO: 301400 - DNA, 20 bp, Artificial Sequence
  Description of Artificial Sequence: Synthetic oligonucleotide
  Target: ATXN1; (+) strand; PAM type: YTN; PAM sequence: TTT
gatgcatgcataaaaattcc

SEQ ID NO: 301401 - DNA, 20 bp, Artificial Sequence
  Description of Artificial Sequence: Synthetic oligonucleotide
  Target: ATXN1; (+) strand; PAM type: YTN; PAM sequence: TTG
atgcatgcataaaaattcca

SEQ ID NO: 301402 - DNA, 20 bp, Artificial Sequence
  Description of Artificial Sequence: Synthetic oligonucleotide
  Target: ATXN1; (+) strand; PAM type: YTN; PAM sequence: TTC
catagctcctcctcctgcag

SEQ ID NO: 301403 - DNA, 20 bp, Artificial Sequence
  Description of Artificial Sequence: Synthetic oligonucleotide
  Target: ATXN1; (+) strand; PAM type: YTN; PAM sequence: CTC
ctcctcctgcagtagaagca

SEQ ID NO: 301404 - DNA, 20 bp, Artificial Sequence
  Description of Artificial Sequence: Synthetic oligonucleotide
  Target: ATXN1; (+) strand; PAM type: YTN; PAM sequence: CTC
ctcctgcagtagaagcagaa

SEQ ID NO: 301405 - DNA, 20 bp, Artificial Sequence
  Description of Artificial Sequence: Synthetic oligonucleotide
  Target: ATXN1; (+) strand; PAM type: YTN; PAM sequence: CTC
ctgcagtagaagcagaagta

SEQ ID NO: 301406 - DNA, 20 bp, Artificial Sequence
  Description of Artificial Sequence: Synthetic oligonucleotide
  Target: ATXN1; (+) strand; PAM type: YTN; PAM sequence: CTG
cagtagaagcagaagtagca

SEQ ID NO: 301407 - DNA, 20 bp, Artificial Sequence
  Description of Artificial Sequence: Synthetic oligonucleotide
  Target: ATXN1; (+) strand; PAM type: YTN; PAM sequence: CTG
gcaaacctgtagtatccaga

SEQ ID NO: 301408 - DNA, 20 bp, Artificial Sequence
  Description of Artificial Sequence: Synthetic oligonucleotide
  Target: ATXN1; (+) strand; PAM type: YTN; PAM sequence: CTG
tagtatccagatgactacct

SEQ ID NO: 301409 - DNA, 20 bp, Artificial Sequence
  Description of Artificial Sequence: Synthetic oligonucleotide
  Target: ATXN1; (+) strand; PAM type: YTN; PAM sequence: CTA
cctctgtttcctggaataac

SEQ ID NO: 301410 - DNA, 20 bp, Artificial Sequence
  Description of Artificial Sequence: Synthetic oligonucleotide
  Target: ATXN1; (+) strand; PAM type: YTN; PAM sequence: CTC
tgtttcctggaataacagaa

SEQ ID NO: 301411 - DNA, 20 bp, Artificial Sequence
  Description of Artificial Sequence: Synthetic oligonucleotide
  Target: ATXN1; (+) strand; PAM type: YTN; PAM sequence: CTG
tttcctggaataacagaagc

SEQ ID NO: 301412 - DNA, 20 bp, Artificial Sequence
  Description of Artificial Sequence: Synthetic oligonucleotide
  Target: ATXN1; (+) strand; PAM type: YTN; PAM sequence: TTT
cctggaataacagaagctga

SEQ ID NO: 301413 - DNA, 20 bp, Artificial Sequence
  Description of Artificial Sequence: Synthetic oligonucleotide
  Target: ATXN1; (+) strand; PAM type: YTN; PAM sequence: TTC
ctggaataacagaagctgaa

SEQ ID NO: 301414 - DNA, 20 bp, Artificial Sequence
  Description of Artificial Sequence: Synthetic oligonucleotide
  Target: ATXN1; (+) strand; PAM type: YTN; PAM sequence: CTG
gaataacagaagctgaagat

SEQ ID NO: 301415 - DNA, 20 bp, Artificial Sequence
  Description of Artificial Sequence: Synthetic oligonucleotide
  Target: ATXN1; (+) strand; PAM type: YTN; PAM sequence: CTG
aagatgaacaggtcatcatc

SEQ ID NO: 301416 - DNA, 20 bp, Artificial Sequence
  Description of Artificial Sequence: Synthetic oligonucleotide
  Target: ATXN1; (+) strand; PAM type: YTN; PAM sequence: CTC
ccaggtaccacccaagtacc

SEQ ID NO: 301417 - DNA, 20 bp, Artificial Sequence
  Description of Artificial Sequence: Synthetic oligonucleotide
  Target: ATXN1; (+) strand; PAM type: YTN; PAM sequence: TTC
tagagccctgggcccagcct

SEQ ID NO: 301418 - DNA, 20 bp, Artificial Sequence
  Description of Artificial Sequence: Synthetic oligonucleotide
  Target: ATXN1; (+) strand; PAM type: YTN; PAM sequence: CTA
gagccctgggcccagcctag

SEQ ID NO: 301419 - DNA, 20 bp, Artificial Sequence
  Description of Artificial Sequence: Synthetic oligonucleotide
  Target: ATXN1; (+) strand; PAM type: YTN; PAM sequence: CTG
ggcccagcctaggacggaga

SEQ ID NO: 301420 - DNA, 20 bp, Artificial Sequence
  Description of Artificial Sequence: Synthetic oligonucleotide
  Target: ATXN1; (+) strand; PAM type: YTN; PAM sequence: CTA
ggacggagacagcttctgaa

SEQ ID NO: 301421 - DNA, 20 bp, Artificial Sequence
  Description of Artificial Sequence: Synthetic oligonucleotide
  Target: ATXN1; (+) strand; PAM type: YTN; PAM sequence: CTT
ctgaagttcttagtctacat

SEQ ID NO: 301422 - DNA, 20 bp, Artificial Sequence
  Description of Artificial Sequence: Synthetic oligonucleotide
  Target: ATXN1; (+) strand; PAM type: YTN; PAM sequence: TTC
tgaagttcttagtctacatc

SEQ ID NO: 301423 - DNA, 20 bp, Artificial Sequence
  Description of Artificial Sequence: Synthetic oligonucleotide
  Target: ATXN1; (+) strand; PAM type: YTN; PAM sequence: CTG
aagttcttagtctacatcta

SEQ ID NO: 301424 - DNA, 20 bp, Artificial Sequence
  Description of Artificial Sequence: Synthetic oligonucleotide
  Target: ATXN1; (+) strand; PAM type: YTN; PAM sequence: TTC
ttagtctacatctaacaggc

SEQ ID NO: 301425 - DNA, 20 bp, Artificial Sequence
  Description of Artificial Sequence: Synthetic oligonucleotide
  Target: ATXN1; (+) strand; PAM type: YTN; PAM sequence: CTT
agtctacatctaacaggcct

SEQ ID NO: 301426 - DNA, 20 bp, Artificial Sequence
  Description of Artificial Sequence: Synthetic oligonucleotide
  Target: ATXN1; (+) strand; PAM type: YTN; PAM sequence: TTA
gtctacatctaacaggcctg

SEQ ID NO: 301427 - DNA, 20 bp, Artificial Sequence
  Description of Artificial Sequence: Synthetic oligonucleotide
  Target: ATXN1; (+) strand; PAM type: YTN; PAM sequence: CTA
catctaacaggcctgtcttt

SEQ ID NO: 301428 - DNA, 20 bp, Artificial Sequence
  Description of Artificial Sequence: Synthetic oligonucleotide
  Target: ATXN1; (+) strand; PAM type: YTN; PAM sequence: CTA
acaggcctgtctttcctcct

SEQ ID NO: 301429 - DNA, 20 bp, Artificial Sequence
  Description of Artificial Sequence: Synthetic oligonucleotide
  Target: ATXN1; (+) strand; PAM type: YTN; PAM sequence: CTG
tctttcctccttgctgtggt

SEQ ID NO: 301430 - DNA, 20 bp, Artificial Sequence
  Description of Artificial Sequence: Synthetic oligonucleotide
  Target: ATXN1; (+) strand; PAM type: YTN; PAM sequence: CTT
tcctccttgctgtggttaac

SEQ ID NO: 301431 - DNA, 20 bp, Artificial Sequence
  Description of Artificial Sequence: Synthetic oligonucleotide
  Target: ATXN1; (+) strand; PAM type: YTN; PAM sequence: TTT
cctccttgctgtggttaaca

SEQ ID NO: 301432 - DNA, 20 bp, Artificial Sequence
  Description of Artificial Sequence: Synthetic oligonucleotide
  Target: ATXN1; (+) strand; PAM type: YTN; PAM sequence: TTC
ctccttgctgtggttaacac

SEQ ID NO: 301433 - DNA, 20 bp, Artificial Sequence
  Description of Artificial Sequence: Synthetic oligonucleotide
  Target: ATXN1; (+) strand; PAM type: YTN; PAM sequence: CTC
cttgctgtggttaacactga

SEQ ID NO: 301434 - DNA, 20 bp, Artificial Sequence
  Description of Artificial Sequence: Synthetic oligonucleotide
  Target: ATXN1; (+) strand; PAM type: YTN; PAM sequence: CTT
gctgtggttaacactgaagt

SEQ ID NO: 301435 - DNA, 20 bp, Artificial Sequence
  Description of Artificial Sequence: Synthetic oligonucleotide
  Target: ATXN1; (+) strand; PAM type: YTN; PAM sequence: TTG
ctgtggttaacactgaagtt

SEQ ID NO: 301436 - DNA, 20 bp, Artificial Sequence
  Description of Artificial Sequence: Synthetic oligonucleotide
  Target: ATXN1; (+) strand; PAM type: YTN; PAM sequence: CTG
tggttaacactgaagttcta

SEQ ID NO: 301437 - DNA, 20 bp, Artificial Sequence
  Description of Artificial Sequence: Synthetic oligonucleotide
  Target: ATXN1; (+) strand; PAM type: YTN; PAM sequence: TTA
acactgaagttctagaaaat

SEQ ID NO: 301438 - DNA, 20 bp, Artificial Sequence
  Description of Artificial Sequence: Synthetic oligonucleotide
  Target: ATXN1; (+) strand; PAM type: YTN; PAM sequence: CTG
aagttctagaaaatgtccta

SEQ ID NO: 301439 - DNA, 20 bp, Artificial Sequence
  Description of Artificial Sequence: Synthetic oligonucleotide
  Target: ATXN1; (+) strand; PAM type: YTN; PAM sequence: TTC
tagaaaatgtcctattagta

SEQ ID NO: 301440 - DNA, 20 bp, Artificial Sequence
  Description of Artificial Sequence: Synthetic oligonucleotide
  Target: ATXN1; (+) strand; PAM type: YTN; PAM sequence: CTA
gaaaatgtcctattagtacc

SEQ ID NO: 301441 - DNA, 20 bp, Artificial Sequence
  Description of Artificial Sequence: Synthetic oligonucleotide
  Target: ATXN1; (+) strand; PAM type: YTN; PAM sequence: CTA
ttagtaccttcatcttgaga

SEQ ID NO: 301442 - DNA, 20 bp, Artificial Sequence
  Description of Artificial Sequence: Synthetic oligonucleotide
  Target: ATXN1; (+) strand; PAM type: YTN; PAM sequence: TTA
gtaccttcatcttgagaggt

SEQ ID NO: 301443 - DNA, 20 bp, Artificial Sequence
  Description of Artificial Sequence: Synthetic oligonucleotide
  Target: ATXN1; (+) strand; PAM type: YTN; PAM sequence: CTT
catcttgagaggtgaatgat

SEQ ID NO: 301444 - DNA, 20 bp, Artificial Sequence
  Description of Artificial Sequence: Synthetic oligonucleotide
  Target: ATXN1; (+) strand; PAM type: YTN; PAM sequence: TTC
atcttgagaggtgaatgatt

SEQ ID NO: 301445 - DNA, 20 bp, Artificial Sequence
  Description of Artificial Sequence: Synthetic oligonucleotide
  Target: ATXN1; (+) strand; PAM type: YTN; PAM sequence: CTT
gagaggtgaatgatttaaga

SEQ ID NO: 301446 - DNA, 20 bp, Artificial Sequence
  Description of Artificial Sequence: Synthetic oligonucleotide
  Target: ATXN1; (+) strand; PAM type: YTN; PAM sequence: TTG
agaggtgaatgatttaagaa

SEQ ID NO: 301447 - DNA, 20 bp, Artificial Sequence
  Description of Artificial Sequence: Synthetic oligonucleotide
  Target: ATXN1; (+) strand; PAM type: YTN; PAM sequence: TTT
aagaagagaagtgactgtat

SEQ ID NO: 301448 - DNA, 20 bp, Artificial Sequence
  Description of Artificial Sequence: Synthetic oligonucleotide
  Target: ATXN1; (+) strand; PAM type: YTN; PAM sequence: TTA
agaagagaagtgactgtatt

SEQ ID NO: 301449 - DNA, 20 bp, Artificial Sequence
  Description of Artificial Sequence: Synthetic oligonucleotide
  Target: ATXN1; (+) strand; PAM type: YTN; PAM sequence: CTG
tatttatttttattttaccc

SEQ ID NO: 301450 - DNA, 20 bp, Artificial Sequence
  Description of Artificial Sequence: Synthetic oligonucleotide
  Target: ATXN1; (+) strand; PAM type: YTN; PAM sequence: TTT
atttttattttacccaatgt

SEQ ID NO: 301451 - DNA, 20 bp, Artificial Sequence
  Description of Artificial Sequence: Synthetic oligonucleotide
  Target: ATXN1; (+) strand; PAM type: YTN; PAM sequence: TTA
tttttattttacccaatgtc

SEQ ID NO: 301452 - DNA, 20 bp, Artificial Sequence
  Description of Artificial Sequence: Synthetic oligonucleotide
  Target: ATXN1; (+) strand; PAM type: YTN; PAM sequence: TTT
ttattttacccaatgtccat

SEQ ID NO: 301453 - DNA, 20 bp, Artificial Sequence
  Description of Artificial Sequence: Synthetic oligonucleotide
  Target: ATXN1; (+) strand; PAM type: YTN; PAM sequence: TTT
tattttacccaatgtccatt

SEQ ID NO: 301454 - DNA, 20 bp, Artificial Sequence
  Description of Artificial Sequence: Synthetic oligonucleotide
  Target: ATXN1; (+) strand; PAM type: YTN; PAM sequence: TTT
attttacccaatgtccattt

SEQ ID NO: 301455 - DNA, 20 bp, Artificial Sequence
  Description of Artificial Sequence: Synthetic oligonucleotide
  Target: ATXN1; (+) strand; PAM type: YTN; PAM sequence: TTA
ttttacccaatgtccatttg

SEQ ID NO: 301456 - DNA, 20 bp, Artificial Sequence
  Description of Artificial Sequence: Synthetic oligonucleotide
  Target: ATXN1; (+) strand; PAM type: YTN; PAM sequence: TTT
tacccaatgtccatttgggc

SEQ ID NO: 301457 - DNA, 20 bp, Artificial Sequence
  Description of Artificial Sequence: Synthetic oligonucleotide
  Target: ATXN1; (+) strand; PAM type: YTN; PAM sequence: TTT
acccaatgtccatttgggca

SEQ ID NO: 301458 - DNA, 20 bp, Artificial Sequence
  Description of Artificial Sequence: Synthetic oligonucleotide
  Target: ATXN1; (+) strand; PAM type: YTN; PAM sequence: TTA
cccaatgtccatttgggcag

SEQ ID NO: 301459 - DNA, 20 bp, Artificial Sequence
  Description of Artificial Sequence: Synthetic oligonucleotide
  Target: ATXN1; (+) strand; PAM type: YTN; PAM sequence: TTT
gggcagttactaaacttaaa

SEQ ID NO: 301460 - DNA, 20 bp, Artificial Sequence
  Description of Artificial Sequence: Synthetic oligonucleotide
  Target: ATXN1; (+) strand; PAM type: YTN; PAM sequence: TTG
ggcagttactaaacttaaaa

SEQ ID NO: 301461 - DNA, 20 bp, Artificial Sequence
  Description of Artificial Sequence: Synthetic oligonucleotide
  Target: ATXN1; (+) strand; PAM type: YTN; PAM sequence: TTA
ctaaacttaaaaatgcagcc

SEQ ID NO: 301462 - DNA, 20 bp, Artificial Sequence
  Description of Artificial Sequence: Synthetic oligonucleotide
  Target: ATXN1; (+) strand; PAM type: YTN; PAM sequence: CTA
aacttaaaaatgcagcctgg

SEQ ID NO: 301463 - DNA, 20 bp, Artificial Sequence
  Description of Artificial Sequence: Synthetic oligonucleotide
  Target: ATXN1; (+) strand; PAM type: YTN; PAM sequence: CTT
aaaaatgcagcctgggcaat

SEQ ID NO: 301464 - DNA, 20 bp, Artificial Sequence
  Description of Artificial Sequence: Synthetic oligonucleotide
  Target: ATXN1; (+) strand; PAM type: YTN; PAM sequence: TTA
aaaatgcagcctgggcaatg

SEQ ID NO: 301465 - DNA, 20 bp, Artificial Sequence
  Description of Artificial Sequence: Synthetic oligonucleotide
  Target: ATXN1; (+) strand; PAM type: YTN; PAM sequence: CTG
ggcaatggaatgagaccctg

SEQ ID NO: 301466 - DNA, 20 bp, Artificial Sequence
  Description of Artificial Sequence: Synthetic oligonucleotide
  Target: ATXN1; (+) strand; PAM type: YTN; PAM sequence: CTG
tctttacaaaaaataaatta

SEQ ID NO: 301467 - DNA, 20 bp, Artificial Sequence
  Description of Artificial Sequence: Synthetic oligonucleotide
  Target: ATXN1; (+) strand; PAM type: YTN; PAM sequence: CTT
tacaaaaaataaattaaaaa

SEQ ID NO: 301468 - DNA, 20 bp, Artificial Sequence
  Description of Artificial Sequence: Synthetic oligonucleotide
  Target: ATXN1; (+) strand; PAM type: YTN; PAM sequence: TTT
acaaaaaataaattaaaaac

SEQ ID NO: 301469 - DNA, 20 bp, Artificial Sequence
  Description of Artificial Sequence: Synthetic oligonucleotide
  Target: ATXN1; (+) strand; PAM type: YTN; PAM sequence: TTA
caaaaaataaattaaaaaca

SEQ ID NO: 301470 - DNA, 20 bp, Artificial Sequence
  Description of Artificial Sequence: Synthetic oligonucleotide
  Target: ATXN1; (+) strand; PAM type: YTN; PAM sequence: TTA
aaaacaaaaaataagtgtgg

SEQ ID NO: 301471 - DNA, 20 bp, Artificial Sequence
  Description of Artificial Sequence: Synthetic oligonucleotide
  Target: ATXN1; (+) strand; PAM type: YTN; PAM sequence: CTG
tagtcctagctactcagcag

SEQ ID NO: 301472 - DNA, 20 bp, Artificial Sequence
  Description of Artificial Sequence: Synthetic oligonucleotide
  Target: ATXN1; (+) strand; PAM type: YTN; PAM sequence: CTA
gctactcagcaggctgaggc

SEQ ID NO: 301473 - DNA, 20 bp, Artificial Sequence
  Description of Artificial Sequence: Synthetic oligonucleotide
  Target: ATXN1; (+) strand; PAM type: YTN; PAM sequence: CTA
ctcagcaggctgaggcggga

SEQ ID NO: 301474 - DNA, 20 bp, Artificial Sequence
  Description of Artificial Sequence: Synthetic oligonucleotide
  Target: ATXN1; (+) strand; PAM type: YTN; PAM sequence: CTC
agcaggctgaggcgggagga

SEQ ID NO: 301475 - DNA, 20 bp, Artificial Sequence
  Description of Artificial Sequence: Synthetic oligonucleotide
  Target: ATXN1; (+) strand; PAM type: YTN; PAM sequence: CTG
aggcgggaggatcactggag

SEQ ID NO: 301476 - DNA, 20 bp, Artificial Sequence
  Description of Artificial Sequence: Synthetic oligonucleotide
  Target: ATXN1; (+) strand; PAM type: YTN; PAM sequence: CTG
gagcccaggagttcgacact

SEQ ID NO: 301477 - DNA, 20 bp, Artificial Sequence
  Description of Artificial Sequence: Synthetic oligonucleotide
  Target: ATXN1; (+) strand; PAM type: YTN; PAM sequence: TTC
gacactacagtgagctatga

SEQ ID NO: 301478 - DNA, 20 bp, Artificial Sequence
  Description of Artificial Sequence: Synthetic oligonucleotide
  Target: ATXN1; (+) strand; PAM type: YTN; PAM sequence: CTA
cagtgagctatgatggcacc

SEQ ID NO: 301479 - DNA, 20 bp, Artificial Sequence
  Description of Artificial Sequence: Synthetic oligonucleotide
  Target: ATXN1; (+) strand; PAM type: YTN; PAM sequence: CTA
tgatggcaccactaccctct

SEQ ID NO: 301480 - DNA, 20 bp, Artificial Sequence
  Description of Artificial Sequence: Synthetic oligonucleotide
  Target: ATXN1; (+) strand; PAM type: YTN; PAM sequence: CTA
ccctctggcctgggcaacag

SEQ ID NO: 301481 - DNA, 20 bp, Artificial Sequence
  Description of Artificial Sequence: Synthetic oligonucleotide
  Target: ATXN1; (+) strand; PAM type: YTN; PAM sequence: CTC
tggcctgggcaacagagtga

SEQ ID NO: 301482 - DNA, 20 bp, Artificial Sequence
  Description of Artificial Sequence: Synthetic oligonucleotide
  Target: ATXN1; (+) strand; PAM type: YTN; PAM sequence: CTG
gcctgggcaacagagtgaga

SEQ ID NO: 301483 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagtgagactctg

SEQ ID NO: 301484 - DNA, 20 bp, Artificial Sequence
  Description of Artificial Sequence: Synthetic oligonucleotide
  Target: ATXN1; (+) strand; PAM type: YTN; PAM sequence: CTC
tgtttctctctctatatata

SEQ ID NO: 301485 - DNA, 20 bp, Artificial Sequence
  Description of Artificial Sequence: Synthetic oligonucleotide
  Target: ATXN1; (+) strand; PAM type: YTN; PAM sequence: CTG
tttctctctctatatataca

SEQ ID NO: 301486 - DNA, 20 bp, Artificial Sequence
  Description of Artificial Sequence: Synthetic oligonucleotide
  Target: ATXN1; (+) strand; PAM type: YTN; PAM sequence: TTT
ctctctctatatatacaaat

SEQ ID NO: 301487 - DNA, 20 bp, Artificial Sequence
  Description of Artificial Sequence: Synthetic oligonucleotide
  Target: ATXN1; (+) strand; PAM type: YTN; PAM sequence: TTC
tctctctatatatacaaata

SEQ ID NO: 301488 - DNA, 20 bp, Artificial Sequence
  Description of Artificial Sequence: Synthetic oligonucleotide
  Target: ATXN1; (+) strand; PAM type: YTN; PAM sequence: CTC
tctctatatatacaaataaa

SEQ ID NO: 301489 - DNA, 20 bp, Artificial Sequence
  Description of Artificial Sequence: Synthetic oligonucleotide
  Target: ATXN1; (+) strand; PAM type: YTN; PAM sequence: CTC
tctatatatacaaataaata

SEQ ID NO: 301490 - DNA, 20 bp, Artificial Sequence
  Description of Artificial Sequence: Synthetic oligonucleotide
  Target: ATXN1; (+) strand; PAM type: YTN; PAM sequence: CTC
tatatatacaaataaataaa

SEQ ID NO: 301491 - DNA, 20 bp, Artificial Sequence
  Description of Artificial Sequence: Synthetic oligonucleotide
  Target: ATXN1; (+) strand; PAM type: YTN; PAM sequence: CTA
tatatacaaataaataaatg

SEQ ID NO: 301492 - DNA, 20 bp, Artificial Sequence
  Description of Artificial Sequence: Synthetic oligonucleotide
  Target: ATXN1; (+) strand; PAM type: YTN; PAM sequence: CTT
actttatatattaatgtctt

SEQ ID NO: 301493 - DNA, 20 bp, Artificial Sequence
  Description of Artificial Sequence: Synthetic oligonucleotide
  Target: ATXN1; (+) strand; PAM type: YTN; PAM sequence: TTA
ctttatatattaatgtctta

SEQ ID NO: 301494 - DNA, 20 bp, Artificial Sequence
  Description of Artificial Sequence: Synthetic oligonucleotide
  Target: ATXN1; (+) strand; PAM type: YTN; PAM sequence: CTT
tatatattaatgtcttattt

SEQ ID NO: 301495 - DNA, 20 bp, Artificial Sequence
  Description of Artificial Sequence: Synthetic oligonucleotide
  Target: ATXN1; (+) strand; PAM type: YTN; PAM sequence: TTT
atatattaatgtcttattta

SEQ ID NO: 301496 - DNA, 20 bp, Artificial Sequence
  Description of Artificial Sequence: Synthetic oligonucleotide
  Target: ATXN1; (+) strand; PAM type: YTN; PAM sequence: TTA
tatattaatgtcttatttaa

SEQ ID NO: 301497 - DNA, 20 bp, Artificial Sequence
  Description of Artificial Sequence: Synthetic oligonucleotide
  Target: ATXN1; (+) strand; PAM type: YTN; PAM sequence: TTA
atgtcttatttaaccctgga

SEQ ID NO: 301498 - DNA, 20 bp, Artificial Sequence
  Description of Artificial Sequence: Synthetic oligonucleotide
  Target: ATXN1; (+) strand; PAM type: YTN; PAM sequence: CTT
atttaaccctggacagctct

SEQ ID NO: 301499 - DNA, 20 bp, Artificial Sequence
  Description of Artificial Sequence: Synthetic oligonucleotide
  Target: ATXN1; (+) strand; PAM type: YTN; PAM sequence: TTA
tttaaccctggacagctctc

SEQ ID NO: 301500 - DNA, 20 bp, Artificial Sequence
  Description of Artificial Sequence: Synthetic oligonucleotide
  Target: ATXN1; (+) strand; PAM type: YTN; PAM sequence: TTT
aaccctggacagctctcctg

SEQ ID NO: 301501 - DNA, 20 bp, Artificial Sequence
  Description of Artificial Sequence: Synthetic oligonucleotide
  Target: ATXN1; (+) strand; PAM type: YTN; PAM sequence: TTA
accctggacagctctcctgg

SEQ ID NO: 301502 - DNA, 20 bp, Artificial Sequence
  Description of Artificial Sequence: Synthetic oligonucleotide
  Target: ATXN1; (+) strand; PAM type: YTN; PAM sequence: CTG
gacagctctcctgggctctc

SEQ ID NO: 301503 - DNA, 20 bp, Artificial Sequence
  Description of Artificial Sequence: Synthetic oligonucleotide
  Target: ATXN1; (+) strand; PAM type: YTN; PAM sequence: CTC
tcctgggctctcttagcctt

SEQ ID NO: 301504 - DNA, 20 bp, Artificial Sequence
  Description of Artificial Sequence: Synthetic oligonucleotide
  Target: ATXN1; (+) strand; PAM type: YTN; PAM sequence: CTC
ctgggctctcttagccttca

SEQ ID NO: 301505 - DNA, 20 bp, Artificial Sequence
  Description of Artificial Sequence: Synthetic oligonucleotide
  Target: ATXN1; (+) strand; PAM type: YTN; PAM sequence: CTG
ggctctcttagccttcacca

SEQ ID NO: 301506 - DNA, 20 bp, Artificial Sequence
  Description of Artificial Sequence: Synthetic oligonucleotide
  Target: ATXN1; (+) strand; PAM type: YTN; PAM sequence: CTC
tcttagccttcaccactcag

SEQ ID NO: 301507 - DNA, 20 bp, Artificial Sequence
  Description of Artificial Sequence: Synthetic oligonucleotide
  Target: ATXN1; (+) strand; PAM type: YTN; PAM sequence: CTC
ttagccttcaccactcagaa

SEQ ID NO: 301508 - DNA, 20 bp, Artificial Sequence
  Description of Artificial Sequence: Synthetic oligonucleotide
  Target: ATXN1; (+) strand; PAM type: YTN; PAM sequence: CTT
agccttcaccactcagaaca

SEQ ID NO: 301509 - DNA, 20 bp, Artificial Sequence
  Description of Artificial Sequence: Synthetic oligonucleotide
  Target: ATXN1; (+) strand; PAM type: YTN; PAM sequence: TTA
gccttcaccactcagaacat

SEQ ID NO: 301510 - DNA, 20 bp, Artificial Sequence
  Description of Artificial Sequence: Synthetic oligonucleotide
  Target: ATXN1; (+) strand; PAM type: YTN; PAM sequence: CTT
caccactcagaacatggcta

SEQ ID NO: 301511 - DNA, 20 bp, Artificial Sequence
  Description of Artificial Sequence: Synthetic oligonucleotide
  Target: ATXN1; (+) strand; PAM type: YTN; PAM sequence: TTC
accactcagaacatggctat

SEQ ID NO: 301512 - DNA, 20 bp, Artificial Sequence
  Description of Artificial Sequence: Synthetic oligonucleotide
  Target: ATXN1; (+) strand; PAM type: YTN; PAM sequence: CTC
agaacatggctatgaatgcc

SEQ ID NO: 301513 - DNA, 20 bp, Artificial Sequence
  Description of Artificial Sequence: Synthetic oligonucleotide
  Target: ATXN1; (+) strand; PAM type: YTN; PAM sequence: CTA
tgaatgcctcaggccacact

SEQ ID NO: 301514 - DNA, 20 bp, Artificial Sequence
  Description of Artificial Sequence: Synthetic oligonucleotide
  Target: ATXN1; (+) strand; PAM type: YTN; PAM sequence: CTC
aggccacactggctaggtgg

SEQ ID NO: 301515 - DNA, 20 bp, Artificial Sequence
  Description of Artificial Sequence: Synthetic oligonucleotide
  Target: ATXN1; (+) strand; PAM type: YTN; PAM sequence: CTG
gctaggtggagagagctagg

SEQ ID NO: 301516 - DNA, 20 bp, Artificial Sequence
  Description of Artificial Sequence: Synthetic oligonucleotide
  Target: ATXN1; (+) strand; PAM type: YTN; PAM sequence: CTA
ggtggagagagctaggaatg

SEQ ID NO: 301517 - DNA, 20 bp, Artificial Sequence
  Description of Artificial Sequence: Synthetic oligonucleotide
  Target: ATXN1; (+) strand; PAM type: YTN; PAM sequence: CTA
ggaatgagaattaatgtata

SEQ ID NO: 301518 - DNA, 20 bp, Artificial Sequence
  Description of Artificial Sequence: Synthetic oligonucleotide
  Target: ATXN1; (+) strand; PAM type: YTN; PAM sequence: TTA
atgtatatgattcagcttag

SEQ ID NO: 301519 - DNA, 20 bp, Artificial Sequence
  Description of Artificial Sequence: Synthetic oligonucleotide
  Target: ATXN1; (+) strand; PAM type: YTN; PAM sequence: TTC
agcttagtgattttatcaga

SEQ ID NO: 301520 - DNA, 20 bp, Artificial Sequence
  Description of Artificial Sequence: Synthetic oligonucleotide
  Target: ATXN1; (+) strand; PAM type: YTN; PAM sequence: CTT
agtgattttatcagattgat

SEQ ID NO: 301521 - DNA, 20 bp, Artificial Sequence
  Description of Artificial Sequence: Synthetic oligonucleotide
  Target: ATXN1; (+) strand; PAM type: YTN; PAM sequence: TTA
gtgattttatcagattgatt

SEQ ID NO: 301522 - DNA, 20 bp, Artificial Sequence
  Description of Artificial Sequence: Synthetic oligonucleotide
  Target: ATXN1; (+) strand; PAM type: YTN; PAM sequence: TTT
tatcagattgattatctggt

SEQ ID NO: 301523 - DNA, 20 bp, Artificial Sequence
  Description of Artificial Sequence: Synthetic oligonucleotide
  Target: ATXN1; (+) strand; PAM type: YTN; PAM sequence: TTT
atcagattgattatctggtt

SEQ ID NO: 301524 - DNA, 20 bp, Artificial Sequence
  Description of Artificial Sequence: Synthetic oligonucleotide
  Target: ATXN1; (+) strand; PAM type: YTN; PAM sequence: TTA
tcagattgattatctggttt

SEQ ID NO: 301525 - DNA, 20 bp, Artificial Sequence
  Description of Artificial Sequence: Synthetic oligonucleotide
  Target: ATXN1; (+) strand; PAM type: YTN; PAM sequence: TTG
attatctggtttctcttaag

SEQ ID NO: 301526 - DNA, 20 bp, Artificial Sequence
  Description of Artificial Sequence: Synthetic oligonucleotide
  Target: ATXN1; (+) strand; PAM type: YTN; PAM sequence: TTA
tctggtttctcttaagttta

SEQ ID NO: 301527 - DNA, 20 bp, Artificial Sequence
  Description of Artificial Sequence: Synthetic oligonucleotide
  Target: ATXN1; (+) strand; PAM type: YTN; PAM sequence: CTG
gtttctcttaagtttacaga

SEQ ID NO: 301528 - DNA, 20 bp, Artificial Sequence
  Description of Artificial Sequence: Synthetic oligonucleotide
  Target: ATXN1; (+) strand; PAM type: YTN; PAM sequence: TTT
ctcttaagtttacagatata

SEQ ID NO: 301529 - DNA, 20 bp, Artificial Sequence
  Description of Artificial Sequence: Synthetic oligonucleotide
  Target: ATXN1; (+) strand; PAM type: YTN; PAM sequence: TTC
tcttaagtttacagatatag

SEQ ID NO: 301530 - DNA, 20 bp, Artificial Sequence
  Description of Artificial Sequence: Synthetic oligonucleotide
  Target: ATXN1; (+) strand; PAM type: YTN; PAM sequence: CTC
ttaagtttacagatataggc

SEQ ID NO: 301531 - DNA, 20 bp, Artificial Sequence
  Description of Artificial Sequence: Synthetic oligonucleotide
  Target: ATXN1; (+) strand; PAM type: YTN; PAM sequence: CTT
aagtttacagatataggcaa

SEQ ID NO: 301532 - DNA, 20 bp, Artificial Sequence
  Description of Artificial Sequence: Synthetic oligonucleotide
  Target: ATXN1; (+) strand; PAM type: YTN; PAM sequence: TTA
agtttacagatataggcaaa

SEQ ID NO: 301533 - DNA, 20 bp, Artificial Sequence
  Description of Artificial Sequence: Synthetic oligonucleotide
  Target: ATXN1; (+) strand; PAM type: YTN; PAM sequence: TTT
acagatataggcaaatatga

SEQ ID NO: 301534 - DNA, 20 bp, Artificial Sequence
  Description of Artificial Sequence: Synthetic oligonucleotide
  Target: ATXN1; (+) strand; PAM type: YTN; PAM sequence: TTA
cagatataggcaaatatgaa

SEQ ID NO: 301535 - DNA, 20 bp, Artificial Sequence
  Description of Artificial Sequence: Synthetic oligonucleotide
  Target: ATXN1; (+) strand; PAM type: YTN; PAM sequence: TTG
aagacatgacaaccaagaca

SEQ ID NO: 301536 - DNA, 20 bp, Artificial Sequence
  Description of Artificial Sequence: Synthetic oligonucleotide
  Target: ATXN1; (+) strand; PAM type: YTN; PAM sequence: CTG
tggcatcgagaagaattatg

SEQ ID NO: 301537 - DNA, 20 bp, Artificial Sequence
  Description of Artificial Sequence: Synthetic oligonucleotide
  Target: ATXN1; (+) strand; PAM type: YTN; PAM sequence: TTA
tgagcttttgaggcatcagg

SEQ ID NO: 301538 - DNA, 20 bp, Artificial Sequence
  Description of Artificial Sequence: Synthetic oligonucleotide
  Target: ATXN1; (+) strand; PAM type: YTN; PAM sequence: CTT
ttgaggcatcaggacgctac

SEQ ID NO: 301539 - DNA, 20 bp, Artificial Sequence
  Description of Artificial Sequence: Synthetic oligonucleotide
  Target: ATXN1; (+) strand; PAM type: YTN; PAM sequence: TTT
tgaggcatcaggacgctact

SEQ ID NO: 301540 - DNA, 20 bp, Artificial Sequence
  Description of Artificial Sequence: Synthetic oligonucleotide
  Target: ATXN1; (+) strand; PAM type: YTN; PAM sequence: TTT
gaggcatcaggacgctacta

SEQ ID NO: 301541 - DNA, 20 bp, Artificial Sequence
  Description of Artificial Sequence: Synthetic oligonucleotide
  Target: ATXN1; (+) strand; PAM type: YTN; PAM sequence: TTG
aggcatcaggacgctactat

SEQ ID NO: 301542 - DNA, 20 bp, Artificial Sequence
  Description of Artificial Sequence: Synthetic oligonucleotide
  Target: ATXN1; (+) strand; PAM type: YTN; PAM sequence: CTA
ctatgtcgaggtaataactt

SEQ ID NO: 301543 - DNA, 20 bp, Artificial Sequence
  Description of Artificial Sequence: Synthetic oligonucleotide
  Target: ATXN1; (+) strand; PAM type: YTN; PAM sequence: CTA
tgtcgaggtaataacttcac

SEQ ID NO: 301544 - DNA, 20 bp, Artificial Sequence
  Description of Artificial Sequence: Synthetic oligonucleotide
  Target: ATXN1; (+) strand; PAM type: YTN; PAM sequence: CTT
cacagaaatgacaataagtc

SEQ ID NO: 301545 - DNA, 20 bp, Artificial Sequence
  Description of Artificial Sequence: Synthetic oligonucleotide
  Target: ATXN1; (+) strand; PAM type: YTN; PAM sequence: TTC
acagaaatgacaataagtct

SEQ ID NO: 301546 - DNA, 20 bp, Artificial Sequence
  Description of Artificial Sequence: Synthetic oligonucleotide
  Target: ATXN1; (+) strand; PAM type: YTN; PAM sequence: CTC
caagaaaaaaagttaaatta

SEQ ID NO: 301547 - DNA, 20 bp, Artificial Sequence
  Description of Artificial Sequence: Synthetic oligonucleotide
  Target: ATXN1; (+) strand; PAM type: YTN; PAM sequence: TTA
aattatattcactatatagt

SEQ ID NO: 301548 - DNA, 20 bp, Artificial Sequence
  Description of Artificial Sequence: Synthetic oligonucleotide
  Target: ATXN1; (+) strand; PAM type: YTN; PAM sequence: TTA
tattcactatatagtagcac

SEQ ID NO: 301549 - DNA, 20 bp, Artificial Sequence
  Description of Artificial Sequence: Synthetic oligonucleotide
  Target: ATXN1; (+) strand; PAM type: YTN; PAM sequence: TTC
actatatagtagcactctac

SEQ ID NO: 301550 - DNA, 20 bp, Artificial Sequence
  Description of Artificial Sequence: Synthetic oligonucleotide
  Target: ATXN1; (+) strand; PAM type: YTN; PAM sequence: CTA
tatagtagcactctacttag

SEQ ID NO: 301551 - DNA, 20 bp, Artificial Sequence
  Description of Artificial Sequence: Synthetic oligonucleotide
  Target: ATXN1; (+) strand; PAM type: YTN; PAM sequence: CTC
tacttaggaagggaggaaat

SEQ ID NO: 301552 - DNA, 20 bp, Artificial Sequence
  Description of Artificial Sequence: Synthetic oligonucleotide
  Target: ATXN1; (+) strand; PAM type: YTN; PAM sequence: CTA
cttaggaagggaggaaattt

SEQ ID NO: 301553 - DNA, 20 bp, Artificial Sequence
  Description of Artificial Sequence: Synthetic oligonucleotide
  Target: ATXN1; (+) strand; PAM type: YTN; PAM sequence: CTT
aggaagggaggaaattttat

SEQ ID NO: 301554 - DNA, 20 bp, Artificial Sequence
  Description of Artificial Sequence: Synthetic oligonucleotide
  Target: ATXN1; (+) strand; PAM type: YTN; PAM sequence: TTA
ggaagggaggaaattttata

SEQ ID NO: 301555 - DNA, 20 bp, Artificial Sequence
  Description of Artificial Sequence: Synthetic oligonucleotide
  Target: ATXN1; (+) strand; PAM type: YTN; PAM sequence: TTT
tataatacattttacaatga

SEQ ID NO: 301556 - DNA, 20 bp, Artificial Sequence
  Description of Artificial Sequence: Synthetic oligonucleotide
  Target: ATXN1; (+) strand; PAM type: YTN; PAM sequence: TTT
ataatacattttacaatgat

SEQ ID NO: 301557 - DNA, 20 bp, Artificial Sequence
  Description of Artificial Sequence: Synthetic oligonucleotide
  Target: ATXN1; (+) strand; PAM type: YTN; PAM sequence: TTA
taatacattttacaatgatt

SEQ ID NO: 301558 - DNA, 20 bp, Artificial Sequence
  Description of Artificial Sequence: Synthetic oligonucleotide
  Target: ATXN1; (+) strand; PAM type: YTN; PAM sequence: TTT
tacaatgatttctgccggaa

SEQ ID NO: 301559 - DNA, 20 bp, Artificial Sequence
  Description of Artificial Sequence: Synthetic oligonucleotide
  Target: ATXN1; (+) strand; PAM type: YTN; PAM sequence: TTT
acaatgatttctgccggaaa

SEQ ID NO: 301560 - DNA, 20 bp, Artificial Sequence
  Description of Artificial Sequence: Synthetic oligonucleotide
  Target: ATXN1; (+) strand; PAM type: YTN; PAM sequence: TTA
caatgatttctgccggaaaa

SEQ ID NO: 301561 - DNA, 20 bp, Artificial Sequence
  Description of Artificial Sequence: Synthetic oligonucleotide
  Target: ATXN1; (+) strand; PAM type: YTN; PAM sequence: TTT
ctgccggaaaatgttgagtt

SEQ ID NO: 301562 - DNA, 20 bp, Artificial Sequence
  Description of Artificial Sequence: Synthetic oligonucleotide
  Target: ATXN1; (+) strand; PAM type: YTN; PAM sequence: TTC
tgccggaaaatgttgagttt

SEQ ID NO: 301563 - DNA, 20 bp, Artificial Sequence
  Description of Artificial Sequence: Synthetic oligonucleotide
  Target: ATXN1; (+) strand; PAM type: YTN; PAM sequence: CTG
ccggaaaatgttgagttttc

SEQ ID NO: 301564 - DNA, 20 bp, Artificial Sequence
  Description of Artificial Sequence: Synthetic oligonucleotide
  Target: ATXN1; (+) strand; PAM type: YTN; PAM sequence: TTG
agttttctcccctttctaac

SEQ ID NO: 301565 - DNA, 20 bp, Artificial Sequence
  Description of Artificial Sequence: Synthetic oligonucleotide
  Target: ATXN1; (+) strand; PAM type: YTN; PAM sequence: TTT
tctcccctttctaacaatgt

SEQ ID NO: 301566 - DNA, 20 bp, Artificial Sequence
  Description of Artificial Sequence: Synthetic oligonucleotide
  Target: ATXN1; (+) strand; PAM type: YTN; PAM sequence: TTT
ctcccctttctaacaatgtc

SEQ ID NO: 301567 - DNA, 20 bp, Artificial Sequence
  Description of Artificial Sequence: Synthetic oligonucleotide
  Target: ATXN1; (+) strand; PAM type: YTN; PAM sequence: TTC
tcccctttctaacaatgtca

SEQ ID NO: 301568 - DNA, 20 bp, Artificial Sequence
  Description of Artificial Sequence: Synthetic oligonucleotide
  Target: ATXN1; (+) strand; PAM type: YTN; PAM sequence: CTC
ccctttctaacaatgtcagc

SEQ ID NO: 301569 - DNA, 20 bp, Artificial Sequence
  Description of Artificial Sequence: Synthetic oligonucleotide
  Target: ATXN1; (+) strand; PAM type: YTN; PAM sequence: CTT
tctaacaatgtcagcattaa

SEQ ID NO: 301570 - DNA, 20 bp, Artificial Sequence
  Description of Artificial Sequence: Synthetic oligonucleotide
  Target: ATXN1; (+) strand; PAM type: YTN; PAM sequence: TTT
ctaacaatgtcagcattaat

SEQ ID NO: 301571 - DNA, 20 bp, Artificial Sequence
  Description of Artificial Sequence: Synthetic oligonucleotide
  Target: ATXN1; (+) strand; PAM type: YTN; PAM sequence: TTC
taacaatgtcagcattaatg

SEQ ID NO: 301572 - DNA, 20 bp, Artificial Sequence
  Description of Artificial Sequence: Synthetic oligonucleotide
  Target: ATXN1; (+) strand; PAM type: YTN; PAM sequence: CTA
acaatgtcagcattaatgca

SEQ ID NO: 301573 - DNA, 20 bp, Artificial Sequence
  Description of Artificial Sequence: Synthetic oligonucleotide
  Target: ATXN1; (+) strand; PAM type: YTN; PAM sequence: TTA
atgcatttaaataatattct

SEQ ID NO: 301574 - DNA, 20 bp, Artificial Sequence
  Description of Artificial Sequence: Synthetic oligonucleotide
  Target: ATXN1; (+) strand; PAM type: YTN; PAM sequence: TTT
aaataatattctgagtaaat

SEQ ID NO: 301575 - DNA, 20 bp, Artificial Sequence
  Description of Artificial Sequence: Synthetic oligonucleotide
  Target: ATXN1; (+) strand; PAM type: YTN; PAM sequence: TTA
aataatattctgagtaaata

SEQ ID NO: 301576 - DNA, 20 bp, Artificial Sequence
  Description of Artificial Sequence: Synthetic oligonucleotide
  Target: ATXN1; (+) strand; PAM type: YTN; PAM sequence: TTC
tgagtaaatatactatctgg

SEQ ID NO: 301577 - DNA, 20 bp, Artificial Sequence
  Description of Artificial Sequence: Synthetic oligonucleotide
  Target: ATXN1; (+) strand; PAM type: YTN; PAM sequence: CTG
agtaaatatactatctggaa

SEQ ID NO: 301578 - DNA, 20 bp, Artificial Sequence
  Description of Artificial Sequence: Synthetic oligonucleotide
  Target: ATXN1; (+) strand; PAM type: YTN; PAM sequence: CTA
tctggaagcagttatttcag

SEQ ID NO: 301579 - DNA, 20 bp, Artificial Sequence
  Description of Artificial Sequence: Synthetic oligonucleotide
  Target: ATXN1; (+) strand; PAM type: YTN; PAM sequence: CTG
gaagcagttatttcaggagt

SEQ ID NO: 301580 - DNA, 20 bp, Artificial Sequence
  Description of Artificial Sequence: Synthetic oligonucleotide
  Target: ATXN1; (+) strand; PAM type: YTN; PAM sequence: TTA
tttcaggagtctacaaaatt

SEQ ID NO: 301581 - DNA, 20 bp, Artificial Sequence
  Description of Artificial Sequence: Synthetic oligonucleotide
  Target: ATXN1; (+) strand; PAM type: YTN; PAM sequence: TTT
caggagtctacaaaattaaa

SEQ ID NO: 301582 - DNA, 20 bp, Artificial Sequence
  Description of Artificial Sequence: Synthetic oligonucleotide
  Target: ATXN1; (+) strand; PAM type: YTN; PAM sequence: TTC
aggagtctacaaaattaaat

SEQ ID NO: 301583 - DNA, 20 bp, Artificial Sequence
  Description of Artificial Sequence: Synthetic oligonucleotide
  Target: ATXN1; (+) strand; PAM type: YTN; PAM sequence: CTA
caaaattaaatatttaaatc

SEQ ID NO: 301584 - DNA, 20 bp, Artificial Sequence
  Description of Artificial Sequence: Synthetic oligonucleotide
  Target: ATXN1; (+) strand; PAM type: YTN; PAM sequence: TTA
aatatttaaatctttactag

SEQ ID NO: 301585 - DNA, 20 bp, Artificial Sequence
  Description of Artificial Sequence: Synthetic oligonucleotide
  Target: ATXN1; (+) strand; PAM type: YTN; PAM sequence: TTT
aaatctttactagagaaata

SEQ ID NO: 301586 - DNA, 20 bp, Artificial Sequence
  Description of Artificial Sequence: Synthetic oligonucleotide
  Target: ATXN1; (+) strand; PAM type: YTN; PAM sequence: TTA
aatctttactagagaaatat

SEQ ID NO: 301587 - DNA, 20 bp, Artificial Sequence
  Description of Artificial Sequence: Synthetic oligonucleotide
  Target: ATXN1; (+) strand; PAM type: YTN; PAM sequence: CTT
tactagagaaatatggaagt

SEQ ID NO: 301588 - DNA, 20 bp, Artificial Sequence
  Description of Artificial Sequence: Synthetic oligonucleotide
  Target: ATXN1; (+) strand; PAM type: YTN; PAM sequence: TTT
actagagaaatatggaagta

SEQ ID NO: 301589 - DNA, 20 bp, Artificial Sequence
  Description of Artificial Sequence: Synthetic oligonucleotide
  Target: ATXN1; (+) strand; PAM type: YTN; PAM sequence: TTA
ctagagaaatatggaagtaa

SEQ ID NO: 301590 - DNA, 20 bp, Artificial Sequence
  Description of Artificial Sequence: Synthetic oligonucleotide
  Target: ATXN1; (+) strand; PAM type: YTN; PAM sequence: CTA
gagaaatatggaagtaagaa

SEQ ID NO: 301591 - DNA, 20 bp, Artificial Sequence
  Description of Artificial Sequence: Synthetic oligonucleotide
  Target: ATXN1; (+) strand; PAM type: YTN; PAM sequence: TTG
aggaactcttaagaattacg

SEQ ID NO: 301592 - DNA, 20 bp, Artificial Sequence
  Description of Artificial Sequence: Synthetic oligonucleotide
  Target: ATXN1; (+) strand; PAM type: YTN; PAM sequence: CTC
ttaagaattacggttttgca

SEQ ID NO: 301593 - DNA, 20 bp, Artificial Sequence
  Description of Artificial Sequence: Synthetic oligonucleotide
  Target: ATXN1; (+) strand; PAM type: YTN; PAM sequence: CTT
aagaattacggttttgcatt

SEQ ID NO: 301594 - DNA, 20 bp, Artificial Sequence
  Description of Artificial Sequence: Synthetic oligonucleotide
  Target: ATXN1; (+) strand; PAM type: YTN; PAM sequence: TTA
agaattacggttttgcattc

SEQ ID NO: 301595 - DNA, 20 bp, Artificial Sequence
  Description of Artificial Sequence: Synthetic oligonucleotide
  Target: ATXN1; (+) strand; PAM type: YTN; PAM sequence: TTA
cggttttgcattctctgtgt

SEQ ID NO: 301596 - DNA, 20 bp, Artificial Sequence
  Description of Artificial Sequence: Synthetic oligonucleotide
  Target: ATXN1; (+) strand; PAM type: YTN; PAM sequence: TTT
tgcattctctgtgtagagag

SEQ ID NO: 301597 - DNA, 20 bp, Artificial Sequence
  Description of Artificial Sequence: Synthetic oligonucleotide
  Target: ATXN1; (+) strand; PAM type: YTN; PAM sequence: TTT
gcattctctgtgtagagagg

SEQ ID NO: 301598 - DNA, 20 bp, Artificial Sequence
  Description of Artificial Sequence: Synthetic oligonucleotide
  Target: ATXN1; (+) strand; PAM type: YTN; PAM sequence: TTG
cattctctgtgtagagagga

SEQ ID NO: 301599 - DNA, 20 bp, Artificial Sequence
  Description of Artificial Sequence: Synthetic oligonucleotide
  Target: ATXN1; (+) strand; PAM type: YTN; PAM sequence: TTC
tctgtgtagagaggaaccta

SEQ ID NO: 301600 - DNA, 20 bp, Artificial Sequence
  Description of Artificial Sequence: Synthetic oligonucleotide
  Target: ATXN1; (+) strand; PAM type: YTN; PAM sequence: CTC
tgtgtagagaggaacctatg

SEQ ID NO: 301601 - DNA, 20 bp, Artificial Sequence
  Description of Artificial Sequence: Synthetic oligonucleotide
  Target: ATXN1; (+) strand; PAM type: YTN; PAM sequence: CTG
tgtagagaggaacctatgat

SEQ ID NO: 301602 - DNA, 20 bp, Artificial Sequence
  Description of Artificial Sequence: Synthetic oligonucleotide
  Target: ATXN1; (+) strand; PAM type: YTN; PAM sequence: CTA
tgatgggaaaaaataaattt

SEQ ID NO: 301603 - DNA, 20 bp, Artificial Sequence
  Description of Artificial Sequence: Synthetic oligonucleotide
  Target: ATXN1; (+) strand; PAM type: YTN; PAM sequence: TTT
cctttttgacctactggtta

SEQ ID NO: 301604 - DNA, 20 bp, Artificial Sequence
  Description of Artificial Sequence: Synthetic oligonucleotide
  Target: ATXN1; (+) strand; PAM type: YTN; PAM sequence: TTC
ctttttgacctactggttag

SEQ ID NO: 301605 - DNA, 20 bp, Artificial Sequence
  Description of Artificial Sequence: Synthetic oligonucleotide
  Target: ATXN1; (+) strand; PAM type: YTN; PAM sequence: CTT
tttgacctactggttagtgc

SEQ ID NO: 301606 - DNA, 20 bp, Artificial Sequence
  Description of Artificial Sequence: Synthetic oligonucleotide
  Target: ATXN1; (+) strand; PAM type: YTN; PAM sequence: TTT
ttgacctactggttagtgct

SEQ ID NO: 301607 - DNA, 20 bp, Artificial Sequence
  Description of Artificial Sequence: Synthetic oligonucleotide
  Target: ATXN1; (+) strand; PAM type: YTN; PAM sequence: TTT
tgacctactggttagtgctg

SEQ ID NO: 301608 - DNA, 20 bp, Artificial Sequence
  Description of Artificial Sequence: Synthetic oligonucleotide
  Target: ATXN1; (+) strand; PAM type: YTN; PAM sequence: TTT
gacctactggttagtgctgt

SEQ ID NO: 301609 - DNA, 20 bp, Artificial Sequence
  Description of Artificial Sequence: Synthetic oligonucleotide
  Target: ATXN1; (+) strand; PAM type: YTN; PAM sequence: TTG
acctactggttagtgctgtc

SEQ ID NO: 301610 - DNA, 20 bp, Artificial Sequence
  Description of Artificial Sequence: Synthetic oligonucleotide
  Target: ATXN1; (+) strand; PAM type: YTN; PAM sequence: CTA
ctggttagtgctgtcataaa

SEQ ID NO: 301611 - DNA, 20 bp, Artificial Sequence
  Description of Artificial Sequence: Synthetic oligonucleotide
  Target: ATXN1; (+) strand; PAM type: YTN; PAM sequence: CTG
gttagtgctgtcataaagcc

SEQ ID NO: 301612 - DNA, 20 bp, Artificial Sequence
  Description of Artificial Sequence: Synthetic oligonucleotide
  Target: ATXN1; (+) strand; PAM type: YTN; PAM sequence: TTA
gtgctgtcataaagcccctc

SEQ ID NO: 301613 - DNA, 20 bp, Artificial Sequence
  Description of Artificial Sequence: Synthetic oligonucleotide
  Target: ATXN1; (+) strand; PAM type: YTN; PAM sequence: CTG
tcataaagcccctccagctt

SEQ ID NO: 301614 - DNA, 20 bp, Artificial Sequence
  Description of Artificial Sequence: Synthetic oligonucleotide
  Target: ATXN1; (+) strand; PAM type: YTN; PAM sequence: CTC
cagcttaggcgacctgagag

SEQ ID NO: 301615 - DNA, 20 bp, Artificial Sequence
  Description of Artificial Sequence: Synthetic oligonucleotide
  Target: ATXN1; (+) strand; PAM type: YTN; PAM sequence: CTT
aggcgacctgagagaatttt

SEQ ID NO: 301616 - DNA, 20 bp, Artificial Sequence
  Description of Artificial Sequence: Synthetic oligonucleotide
  Target: ATXN1; (+) strand; PAM type: YTN; PAM sequence: TTA
ggcgacctgagagaattttt

SEQ ID NO: 301617 - DNA, 20 bp, Artificial Sequence
  Description of Artificial Sequence: Synthetic oligonucleotide
  Target: ATXN1; (+) strand; PAM type: YTN; PAM sequence: CTG
agagaatttttaaaaccctc

SEQ ID NO: 301618 - DNA, 20 bp, Artificial Sequence
  Description of Artificial Sequence: Synthetic oligonucleotide
  Target: ATXN1; (+) strand; PAM type: YTN; PAM sequence: TTT
ttaaaaccctcttttcagaa

SEQ ID NO: 301619 - DNA, 20 bp, Artificial Sequence
  Description of Artificial Sequence: Synthetic oligonucleotide
  Target: ATXN1; (+) strand; PAM type: YTN; PAM sequence: TTT
taaaaccctcttttcagaat

SEQ ID NO: 301620 - DNA, 20 bp, Artificial Sequence
  Description of Artificial Sequence: Synthetic oligonucleotide
  Target: ATXN1; (+) strand; PAM type: YTN; PAM sequence: TTT
aaaaccctcttttcagaata

SEQ ID NO: 301621 - DNA, 20 bp, Artificial Sequence
  Description of Artificial Sequence: Synthetic oligonucleotide
  Target: ATXN1; (+) strand; PAM type: YTN; PAM sequence: TTA
aaaccctcttttcagaatag

SEQ ID NO: 301622 - DNA, 20 bp, Artificial Sequence
  Description of Artificial Sequence: Synthetic oligonucleotide
  Target: ATXN1; (+) strand; PAM type: YTN; PAM sequence: CTC
ttttcagaatagtggaaaag

SEQ ID NO: 301623 - DNA, 20 bp, Artificial Sequence
  Description of Artificial Sequence: Synthetic oligonucleotide
  Target: ATXN1; (+) strand; PAM type: YTN; PAM sequence: CTT
ttcagaatagtggaaaaggt

SEQ ID NO: 301624 - DNA, 20 bp, Artificial Sequence
  Description of Artificial Sequence: Synthetic oligonucleotide
  Target: ATXN1; (+) strand; PAM type: YTN; PAM sequence: TTT
tcagaatagtggaaaaggtt

SEQ ID NO: 301625 - DNA, 20 bp, Artificial Sequence
  Description of Artificial Sequence: Synthetic oligonucleotide
  Target: ATXN1; (+) strand; PAM type: YTN; PAM sequence: TTT
cagaatagtggaaaaggttt

SEQ ID NO: 301626 - DNA, 20 bp, Artificial Sequence
  Description of Artificial Sequence: Synthetic oligonucleotide
  Target: ATXN1; (+) strand; PAM type: YTN; PAM sequence: TTC
agaatagtggaaaaggtttt

SEQ ID NO: 301627 - DNA, 20 bp, Artificial Sequence
  Description of Artificial Sequence: Synthetic oligonucleotide
  Target: ATXN1; (+) strand; PAM type: YTN; PAM sequence: TTT
tctccccttctcatttccaa

SEQ ID NO: 301628 - DNA, 20 bp, Artificial Sequence
  Description of Artificial Sequence: Synthetic oligonucleotide
  Target: ATXN1; (+) strand; PAM type: YTN; PAM sequence: TTT
ctccccttctcatttccaag

SEQ ID NO: 301629 - DNA, 20 bp, Artificial Sequence
  Description of Artificial Sequence: Synthetic oligonucleotide
  Target: ATXN1; (+) strand; PAM type: YTN; PAM sequence: TTC
tccccttctcatttccaaga

SEQ ID NO: 301630 - DNA, 20 bp, Artificial Sequence
  Description of Artificial Sequence: Synthetic oligonucleotide
  Target: ATXN1; (+) strand; PAM type: YTN; PAM sequence: CTC
cccttctcatttccaagaga

SEQ ID NO: 301631 - DNA, 20 bp, Artificial Sequence
  Description of Artificial Sequence: Synthetic oligonucleotide
  Target: ATXN1; (+) strand; PAM type: YTN; PAM sequence: CTT
ctcatttccaagagaaaggt

SEQ ID NO: 301632 - DNA, 20 bp, Artificial Sequence
  Description of Artificial Sequence: Synthetic oligonucleotide
  Target: ATXN1; (+) strand; PAM type: YTN; PAM sequence: TTC
tcatttccaagagaaaggta

SEQ ID NO: 301633 - DNA, 20 bp, Artificial Sequence
  Description of Artificial Sequence: Synthetic oligonucleotide
  Target: ATXN1; (+) strand; PAM type: YTN; PAM sequence: CTC
atttccaagagaaaggtagt

SEQ ID NO: 301634 - DNA, 20 bp, Artificial Sequence
  Description of Artificial Sequence: Synthetic oligonucleotide
  Target: ATXN1; (+) strand; PAM type: YTN; PAM sequence: TTT
ccaagagaaaggtagtgttg

SEQ ID NO: 301635 - DNA, 20 bp, Artificial Sequence
  Description of Artificial Sequence: Synthetic oligonucleotide
  Target: ATXN1; (+) strand; PAM type: YTN; PAM sequence: TTC
caagagaaaggtagtgttga

SEQ ID NO: 301636 - DNA, 20 bp, Artificial Sequence
  Description of Artificial Sequence: Synthetic oligonucleotide
  Target: ATXN1; (+) strand; PAM type: YTN; PAM sequence: TTG
accctaaaagctaagagagg

SEQ ID NO: 301637 - DNA, 20 bp, Artificial Sequence
  Description of Artificial Sequence: Synthetic oligonucleotide
  Target: ATXN1; (+) strand; PAM type: YTN; PAM sequence: CTA
aaagctaagagaggaaaaga

SEQ ID NO: 301638 - DNA, 20 bp, Artificial Sequence
  Description of Artificial Sequence: Synthetic oligonucleotide
  Target: ATXN1; (+) strand; PAM type: YTN; PAM sequence: CTA
agagaggaaaagactagatg

SEQ ID NO: 301639 - DNA, 20 bp, Artificial Sequence
  Description of Artificial Sequence: Synthetic oligonucleotide
  Target: ATXN1; (+) strand; PAM type: YTN; PAM sequence: CTA
gatgtgtgttgtggaatcct

SEQ ID NO: 301640 - DNA, 20 bp, Artificial Sequence
  Description of Artificial Sequence: Synthetic oligonucleotide
  Target: ATXN1; (+) strand; PAM type: YTN; PAM sequence: TTG
tggaatcctttctcgactct

SEQ ID NO: 301641 - DNA, 20 bp, Artificial Sequence
  Description of Artificial Sequence: Synthetic oligonucleotide
  Target: ATXN1; (+) strand; PAM type: YTN; PAM sequence: CTT
tctcgactcttctttctcta

SEQ ID NO: 301642 - DNA, 20 bp, Artificial Sequence
  Description of Artificial Sequence: Synthetic oligonucleotide
  Target: ATXN1; (+) strand; PAM type: YTN; PAM sequence: TTT
ctcgactcttctttctctaa

SEQ ID NO: 301643 - DNA, 20 bp, Artificial Sequence
  Description of Artificial Sequence: Synthetic oligonucleotide
  Target: ATXN1; (+) strand; PAM type: YTN; PAM sequence: TTC
tcgactcttctttctctaat

SEQ ID NO: 301644 - DNA, 20 bp, Artificial Sequence
  Description of Artificial Sequence: Synthetic oligonucleotide
  Target: ATXN1; (+) strand; PAM type: YTN; PAM sequence: CTC
gactcttctttctctaatat

SEQ ID NO: 301645 - DNA, 20 bp, Artificial Sequence
  Description of Artificial Sequence: Synthetic oligonucleotide
  Target: ATXN1; (+) strand; PAM type: YTN; PAM sequence: CTC
ttctttctctaatattcttg

SEQ ID NO: 301646 - DNA, 20 bp, Artificial Sequence
  Description of Artificial Sequence: Synthetic oligonucleotide
  Target: ATXN1; (+) strand; PAM type: YTN; PAM sequence: CTT
ctttctctaatattcttgct

SEQ ID NO: 301647 - DNA, 20 bp, Artificial Sequence
  Description of Artificial Sequence: Synthetic oligonucleotide
  Target: ATXN1; (+) strand; PAM type: YTN; PAM sequence: TTC
tttctctaatattcttgcta

SEQ ID NO: 301648 - DNA, 20 bp, Artificial Sequence
  Description of Artificial Sequence: Synthetic oligonucleotide
  Target: ATXN1; (+) strand; PAM type: YTN; PAM sequence: CTT
tctctaatattcttgctata

SEQ ID NO: 301649 - DNA, 20 bp, Artificial Sequence
  Description of Artificial Sequence: Synthetic oligonucleotide
  Target: ATXN1; (+) strand; PAM type: YTN; PAM sequence: TTT
ctctaatattcttgctatat

SEQ ID NO: 301650 - DNA, 20 bp, Artificial Sequence
  Description of Artificial Sequence: Synthetic oligonucleotide
  Target: ATXN1; (+) strand; PAM type: YTN; PAM sequence: TTC
tctaatattcttgctatata

SEQ ID NO: 301651 - DNA, 20 bp, Artificial Sequence
  Description of Artificial Sequence: Synthetic oligonucleotide
  Target: ATXN1; (+) strand; PAM type: YTN; PAM sequence: CTC
taatattcttgctatataaa

SEQ ID NO: 301652 - DNA, 20 bp, Artificial Sequence
  Description of Artificial Sequence: Synthetic oligonucleotide
  Target: ATXN1; (+) strand; PAM type: YTN; PAM sequence: CTA
atattcttgctatataaaca

SEQ ID NO: 301653 - DNA, 20 bp, Artificial Sequence
  Description of Artificial Sequence: Synthetic oligonucleotide
  Target: ATXN1; (+) strand; PAM type: YTN; PAM sequence: TTC
ttgctatataaacatggtag

SEQ ID NO: 301654 - DNA, 20 bp, Artificial Sequence
  Description of Artificial Sequence: Synthetic oligonucleotide
  Target: ATXN1; (+) strand; PAM type: YTN; PAM sequence: CTT
gctatataaacatggtagtt

SEQ ID NO: 301655 - DNA, 20 bp, Artificial Sequence
  Description of Artificial Sequence: Synthetic oligonucleotide
  Target: ATXN1; (+) strand; PAM type: YTN; PAM sequence: TTG
ctatataaacatggtagttc

SEQ ID NO: 301656 - DNA, 20 bp, Artificial Sequence
  Description of Artificial Sequence: Synthetic oligonucleotide
  Target: ATXN1; (+) strand; PAM type: YTN; PAM sequence: CTA
tataaacatggtagttccat

SEQ ID NO: 301657 - DNA, 20 bp, Artificial Sequence
  Description of Artificial Sequence: Synthetic oligonucleotide
  Target: ATXN1; (+) strand; PAM type: YTN; PAM sequence: TTC
catcagtaagagttttaagg

SEQ ID NO: 301658 - DNA, 20 bp, Artificial Sequence
  Description of Artificial Sequence: Synthetic oligonucleotide
  Target: ATXN1; (+) strand; PAM type: YTN; PAM sequence: TTT
taaggaagcgttggcgaggc

SEQ ID NO: 301659 - DNA, 20 bp, Artificial Sequence
  Description of Artificial Sequence: Synthetic oligonucleotide
  Target: ATXN1; (+) strand; PAM type: YTN; PAM sequence: TTT
aaggaagcgttggcgaggct

SEQ ID NO: 301660 - DNA, 20 bp, Artificial Sequence
  Description of Artificial Sequence: Synthetic oligonucleotide
  Target: ATXN1; (+) strand; PAM type: YTN; PAM sequence: TTA
aggaagcgttggcgaggctt

SEQ ID NO: 301661 - DNA, 20 bp, Artificial Sequence
  Description of Artificial Sequence: Synthetic oligonucleotide
  Target: ATXN1; (+) strand; PAM type: YTN; PAM sequence: TTG
gcgaggcttgctcactcttt

SEQ ID NO: 301662 - DNA, 20 bp, Artificial Sequence
  Description of Artificial Sequence: Synthetic oligonucleotide
  Target: ATXN1; (+) strand; PAM type: YTN; PAM sequence: CTT
gctcactctttgggacacca

SEQ ID NO: 301663 - DNA, 20 bp, Artificial Sequence
  Description of Artificial Sequence: Synthetic oligonucleotide
  Target: ATXN1; (+) strand; PAM type: YTN; PAM sequence: TTG
ctcactctttgggacaccac

SEQ ID NO: 301664 - DNA, 20 bp, Artificial Sequence
  Description of Artificial Sequence: Synthetic oligonucleotide
  Target: ATXN1; (+) strand; PAM type: YTN; PAM sequence: CTC
actctttgggacaccacact

SEQ ID NO: 301665 - DNA, 20 bp, Artificial Sequence
  Description of Artificial Sequence: Synthetic oligonucleotide
  Target: ATXN1; (+) strand; PAM type: YTN; PAM sequence: CTC
tttgggacaccacactgtca

SEQ ID NO: 301666 - DNA, 20 bp, Artificial Sequence
  Description of Artificial Sequence: Synthetic oligonucleotide
  Target: ATXN1; (+) strand; PAM type: YTN; PAM sequence: CTT
tgggacaccacactgtcaca

SEQ ID NO: 301667 - DNA, 20 bp, Artificial Sequence
  Description of Artificial Sequence: Synthetic oligonucleotide
  Target: ATXN1; (+) strand; PAM type: YTN; PAM sequence: TTT
gggacaccacactgtcacaa

SEQ ID NO: 301668 - DNA, 20 bp, Artificial Sequence
  Description of Artificial Sequence: Synthetic oligonucleotide
  Target: ATXN1; (+) strand; PAM type: YTN; PAM sequence: TTG
ggacaccacactgtcacaat

SEQ ID NO: 301669 - DNA, 20 bp, Artificial Sequence
  Description of Artificial Sequence: Synthetic oligonucleotide
  Target: ATXN1; (+) strand; PAM type: YTN; PAM sequence: CTG
tcacaatgagtagcaccaac

SEQ ID NO: 301670 - DNA, 20 bp, Artificial Sequence
  Description of Artificial Sequence: Synthetic oligonucleotide
  Target: ATXN1; (+) strand; PAM type: YTN; PAM sequence: TTA
cagtggaaacgccacagtgg

SEQ ID NO: 301671 - DNA, 20 bp, Artificial Sequence
  Description of Artificial Sequence: Synthetic oligonucleotide
  Target: ATXN1; (+) strand; PAM type: YTN; PAM sequence: CTA
gtaacagagtgttagtatta

SEQ ID NO: 301672 - DNA, 20 bp, Artificial Sequence
  Description of Artificial Sequence: Synthetic oligonucleotide
  Target: ATXN1; (+) strand; PAM type: YTN; PAM sequence: TTA
gtattagcgggatgaataca

SEQ ID NO: 301673 - DNA, 20 bp, Artificial Sequence
  Description of Artificial Sequence: Synthetic oligonucleotide
  Target: ATXN1; (+) strand; PAM type: YTN; PAM sequence: TTA
gcgggatgaatacacctgct

SEQ ID NO: 301674 - DNA, 20 bp, Artificial Sequence
  Description of Artificial Sequence: Synthetic oligonucleotide
  Target: ATXN1; (+) strand; PAM type: YTN; PAM sequence: CTG
ctggtgcaatttaggtgaat

SEQ ID NO: 301675 - DNA, 20 bp, Artificial Sequence
  Description of Artificial Sequence: Synthetic oligonucleotide
  Target: ATXN1; (+) strand; PAM type: YTN; PAM sequence: CTG
gtgcaatttaggtgaatttc

SEQ ID NO: 301676 - DNA, 20 bp, Artificial Sequence
  Description of Artificial Sequence: Synthetic oligonucleotide
  Target: ATXN1; (+) strand; PAM type: YTN; PAM sequence: TTT
aggtgaatttccataacaga

SEQ ID NO: 301677 - DNA, 20 bp, Artificial Sequence
  Description of Artificial Sequence: Synthetic oligonucleotide
  Target: ATXN1; (+) strand; PAM type: YTN; PAM sequence: TTA
ggtgaatttccataacagaa

SEQ ID NO: 301678 - DNA, 20 bp, Artificial Sequence
  Description of Artificial Sequence: Synthetic oligonucleotide
  Target: ATXN1; (+) strand; PAM type: YTN; PAM sequence: TTT
ccataacagaacatatatta

SEQ ID NO: 301679 - DNA, 20 bp, Artificial Sequence
  Description of Artificial Sequence: Synthetic oligonucleotide
  Target: ATXN1; (+) strand; PAM type: YTN; PAM sequence: TTC
cataacagaacatatattag

SEQ ID NO: 301680 - DNA, 20 bp, Artificial Sequence
  Description of Artificial Sequence: Synthetic oligonucleotide
  Target: ATXN1; (+) strand; PAM type: YTN; PAM sequence: TTA
gttaattttgctttagatta

SEQ ID NO: 301681 - DNA, 20 bp, Artificial Sequence
  Description of Artificial Sequence: Synthetic oligonucleotide
  Target: ATXN1; (+) strand; PAM type: YTN; PAM sequence: TTA
attttgctttagattatgaa

SEQ ID NO: 301682 - DNA, 20 bp, Artificial Sequence
  Description of Artificial Sequence: Synthetic oligonucleotide
  Target: ATXN1; (+) strand; PAM type: YTN; PAM sequence: TTT
tgctttagattatgaattgg

SEQ ID NO: 301683 - DNA, 20 bp, Artificial Sequence
  Description of Artificial Sequence: Synthetic oligonucleotide
  Target: ATXN1; (+) strand; PAM type: YTN; PAM sequence: TTT
gctttagattatgaattggg

SEQ ID NO: 301684 - DNA, 20 bp, Artificial Sequence
  Description of Artificial Sequence: Synthetic oligonucleotide
  Target: ATXN1; (+) strand; PAM type: YTN; PAM sequence: TTG
ctttagattatgaattggga

SEQ ID NO: 301685 - DNA, 20 bp, Artificial Sequence
  Description of Artificial Sequence: Synthetic oligonucleotide
  Target: ATXN1; (+) strand; PAM type: YTN; PAM sequence: CTT
tagattatgaattgggaaaa

SEQ ID NO: 301686 - DNA, 20 bp, Artificial Sequence
  Description of Artificial Sequence: Synthetic oligonucleotide
  Target: ATXN1; (+) strand; PAM type: YTN; PAM sequence: TTT
agattatgaattgggaaaat

SEQ ID NO: 301687 - DNA, 20 bp, Artificial Sequence
  Description of Artificial Sequence: Synthetic oligonucleotide
  Target: ATXN1; (+) strand; PAM type: YTN; PAM sequence: TTA
gattatgaattgggaaaatt

SEQ ID NO: 301688 - DNA, 20 bp, Artificial Sequence
  Description of Artificial Sequence: Synthetic oligonucleotide
  Target: ATXN1; (+) strand; PAM type: YTN; PAM sequence: TTA
tgaattgggaaaattcctta

SEQ ID NO: 301689 - DNA, 20 bp, Artificial Sequence
  Description of Artificial Sequence: Synthetic oligonucleotide
  Target: ATXN1; (+) strand; PAM type: YTN; PAM sequence: TTG
ggaaaattccttagcatatt

SEQ ID NO: 301690 - DNA, 20 bp, Artificial Sequence
  Description of Artificial Sequence: Synthetic oligonucleotide
  Target: ATXN1; (+) strand; PAM type: YTN; PAM sequence: TTC
cttagcatattattagcata

SEQ ID NO: 301691 - DNA, 20 bp, Artificial Sequence
  Description of Artificial Sequence: Synthetic oligonucleotide
  Target: ATXN1; (+) strand; PAM type: YTN; PAM sequence: CTT
agcatattattagcatatta

SEQ ID NO: 301692 - DNA, 20 bp, Artificial Sequence
  Description of Artificial Sequence: Synthetic oligonucleotide
  Target: ATXN1; (+) strand; PAM type: YTN; PAM sequence: TTA
gcatattattagcatattat

SEQ ID NO: 301693 - DNA, 20 bp, Artificial Sequence
  Description of Artificial Sequence: Synthetic oligonucleotide
  Target: ATXN1; (+) strand; PAM type: YTN; PAM sequence: TTA
ttagcatattatcatatcag

SEQ ID NO: 301694 - DNA, 20 bp, Artificial Sequence
  Description of Artificial Sequence: Synthetic oligonucleotide
  Target: ATXN1; (+) strand; PAM type: YTN; PAM sequence: TTA
gcatattatcatatcagcat

SEQ ID NO: 301695 - DNA, 20 bp, Artificial Sequence
  Description of Artificial Sequence: Synthetic oligonucleotide
  Target: ATXN1; (+) strand; PAM type: YTN; PAM sequence: TTA
tcatatcagcataacaacaa

SEQ ID NO: 301696 - DNA, 20 bp, Artificial Sequence
  Description of Artificial Sequence: Synthetic oligonucleotide
  Target: ATXN1; (+) strand; PAM type: YTN; PAM sequence: TTA
aggacacaaaaattctaatt

SEQ ID NO: 301697 - DNA, 20 bp, Artificial Sequence
  Description of Artificial Sequence: Synthetic oligonucleotide
  Target: ATXN1; (+) strand; PAM type: YTN; PAM sequence: TTC
taattacaagtaagtttttg

SEQ ID NO: 301698 - DNA, 20 bp, Artificial Sequence
  Description of Artificial Sequence: Synthetic oligonucleotide
  Target: ATXN1; (+) strand; PAM type: YTN; PAM sequence: CTA
attacaagtaagtttttgcc

SEQ ID NO: 301699 - DNA, 20 bp, Artificial Sequence
  Description of Artificial Sequence: Synthetic oligonucleotide
  Target: ATXN1; (+) strand; PAM type: YTN; PAM sequence: TTA
caagtaagtttttgccacca

SEQ ID NO: 301700 - DNA, 20 bp, Artificial Sequence
  Description of Artificial Sequence: Synthetic oligonucleotide
  Target: ATXN1; (+) strand; PAM type: YTN; PAM sequence: TTT
ttgccaccaaacttataatt

SEQ ID NO: 301701 - DNA, 20 bp, Artificial Sequence
  Description of Artificial Sequence: Synthetic oligonucleotide
  Target: ATXN1; (+) strand; PAM type: YTN; PAM sequence: TTT
tgccaccaaacttataattt

SEQ ID NO: 301702 - DNA, 20 bp, Artificial Sequence
  Description of Artificial Sequence: Synthetic oligonucleotide
  Target: ATXN1; (+) strand; PAM type: YTN; PAM sequence: TTT
gccaccaaacttataatttc

SEQ ID NO: 301703 - DNA, 20 bp, Artificial Sequence
  Description of Artificial Sequence: Synthetic oligonucleotide
  Target: ATXN1; (+) strand; PAM type: YTN; PAM sequence: TTG
ccaccaaacttataatttcc

SEQ ID NO: 301704 - DNA, 20 bp, Artificial Sequence
  Description of Artificial Sequence: Synthetic oligonucleotide
  Target: ATXN1; (+) strand; PAM type: YTN; PAM sequence: CTT
ataatttccacttcttcaac

SEQ ID NO: 301705 - DNA, 20 bp, Artificial Sequence
  Description of Artificial Sequence: Synthetic oligonucleotide
  Target: ATXN1; (+) strand; PAM type: YTN; PAM sequence: TTA
taatttccacttcttcaact

SEQ ID NO: 301706 - DNA, 20 bp, Artificial Sequence
  Description of Artificial Sequence: Synthetic oligonucleotide
  Target: ATXN1; (+) strand; PAM type: YTN; PAM sequence: TTT
ccacttcttcaactatctgt

SEQ ID NO: 301707 - DNA, 20 bp, Artificial Sequence
  Description of Artificial Sequence: Synthetic oligonucleotide
  Target: ATXN1; (+) strand; PAM type: YTN; PAM sequence: TTC
cacttcttcaactatctgtt

SEQ ID NO: 301708 - DNA, 20 bp, Artificial Sequence
  Description of Artificial Sequence: Synthetic oligonucleotide
  Target: ATXN1; (+) strand; PAM type: YTN; PAM sequence: CTT
cttcaactatctgtttgctt

SEQ ID NO: 301709 - DNA, 20 bp, Artificial Sequence
  Description of Artificial Sequence: Synthetic oligonucleotide
  Target: ATXN1; (+) strand; PAM type: YTN; PAM sequence: TTC
ttcaactatctgtttgcttt

SEQ ID NO: 301710 - DNA, 20 bp, Artificial Sequence
  Description of Artificial Sequence: Synthetic oligonucleotide
  Target: ATXN1; (+) strand; PAM type: YTN; PAM sequence: CTT
caactatctgtttgcttttt

SEQ ID NO: 301711 - DNA, 20 bp, Artificial Sequence
  Description of Artificial Sequence: Synthetic oligonucleotide
  Target: ATXN1; (+) strand; PAM type: YTN; PAM sequence: TTC
aactatctgtttgctttttt

SEQ ID NO: 301712 - DNA, 20 bp, Artificial Sequence
  Description of Artificial Sequence: Synthetic oligonucleotide
  Target: ATXN1; (+) strand; PAM type: YTN; PAM sequence: CTA
tctgtttgcttttttaccct

SEQ ID NO: 301713 - DNA, 20 bp, Artificial Sequence
  Description of Artificial Sequence: Synthetic oligonucleotide
  Target: ATXN1; (+) strand; PAM type: YTN; PAM sequence: CTG
tttgcttttttacccttgga

SEQ ID NO: 301714 - DNA, 20 bp, Artificial Sequence
  Description of Artificial Sequence: Synthetic oligonucleotide
  Target: ATXN1; (+) strand; PAM type: YTN; PAM sequence: TTT
gcttttttacccttggactt

SEQ ID NO: 301715 - DNA, 20 bp, Artificial Sequence
  Description of Artificial Sequence: Synthetic oligonucleotide
  Target: ATXN1; (+) strand; PAM type: YTN; PAM sequence: TTG
cttttttacccttggacttg

SEQ ID NO: 301716 - DNA, 20 bp, Artificial Sequence
  Description of Artificial Sequence: Synthetic oligonucleotide
  Target: ATXN1; (+) strand; PAM type: YTN; PAM sequence: CTT
ttttacccttggacttgtct

SEQ ID NO: 301717 - DNA, 20 bp, Artificial Sequence
  Description of Artificial Sequence: Synthetic oligonucleotide
  Target: ATXN1; (+) strand; PAM type: YTN; PAM sequence: TTT
tttacccttggacttgtcta

SEQ ID NO: 301718 - DNA, 20 bp, Artificial Sequence
  Description of Artificial Sequence: Synthetic oligonucleotide
  Target: ATXN1; (+) strand; PAM type: YTN; PAM sequence: TTT
ttacccttggacttgtctaa

SEQ ID NO: 301719 - DNA, 20 bp, Artificial Sequence
  Description of Artificial Sequence: Synthetic oligonucleotide
  Target: ATXN1; (+) strand; PAM type: YTN; PAM sequence: TTT
tacccttggacttgtctaag

SEQ ID NO: 301720 - DNA, 20 bp, Artificial Sequence
  Description of Artificial Sequence: Synthetic oligonucleotide
  Target: ATXN1; (+) strand; PAM type: YTN; PAM sequence: TTT
acccttggacttgtctaaga

SEQ ID NO: 301721 - DNA, 20 bp, Artificial Sequence
  Description of Artificial Sequence: Synthetic oligonucleotide
  Target: ATXN1; (+) strand; PAM type: YTN; PAM sequence: TTA
cccttggacttgtctaagac

SEQ ID NO: 301722 - DNA, 20 bp, Artificial Sequence
  Description of Artificial Sequence: Synthetic oligonucleotide
  Target: ATXN1; (+) strand; PAM type: YTN; PAM sequence: CTT
ggacttgtctaagactctac

SEQ ID NO: 301723 - DNA, 20 bp, Artificial Sequence
  Description of Artificial Sequence: Synthetic oligonucleotide
  Target: ATXN1; (+) strand; PAM type: YTN; PAM sequence: TTG
gacttgtctaagactctact

SEQ ID NO: 301724 - DNA, 20 bp, Artificial Sequence
  Description of Artificial Sequence: Synthetic oligonucleotide
  Target: ATXN1; (+) strand; PAM type: YTN; PAM sequence: CTT
gtctaagactctactcaggc

SEQ ID NO: 301725 - DNA, 20 bp, Artificial Sequence
  Description of Artificial Sequence: Synthetic oligonucleotide
  Target: ATXN1; (+) strand; PAM type: YTN; PAM sequence: TTG
tctaagactctactcaggcc

SEQ ID NO: 301726 - DNA, 20 bp, Artificial Sequence
  Description of Artificial Sequence: Synthetic oligonucleotide
  Target: ATXN1; (+) strand; PAM type: YTN; PAM sequence: CTA
agactctactcaggccttct

SEQ ID NO: 301727 - DNA, 20 bp, Artificial Sequence
  Description of Artificial Sequence: Synthetic oligonucleotide
  Target: ATXN1; (+) strand; PAM type: YTN; PAM sequence: CTC
tactcaggccttctcttccc

SEQ ID NO: 301728 - DNA, 20 bp, Artificial Sequence
  Description of Artificial Sequence: Synthetic oligonucleotide
  Target: ATXN1; (+) strand; PAM type: YTN; PAM sequence: CTA
ctcaggccttctcttccctt

SEQ ID NO: 301729 - DNA, 20 bp, Artificial Sequence
  Description of Artificial Sequence: Synthetic oligonucleotide
  Target: ATXN1; (+) strand; PAM type: YTN; PAM sequence: CTC
aggccttctcttcccttcaa

SEQ ID NO: 301730 - DNA, 20 bp, Artificial Sequence
  Description of Artificial Sequence: Synthetic oligonucleotide
  Target: ATXN1; (+) strand; PAM type: YTN; PAM sequence: CTT
ctcttcccttcaaatcccag

SEQ ID NO: 301731 - DNA, 20 bp, Artificial Sequence
  Description of Artificial Sequence: Synthetic oligonucleotide
  Target: ATXN1; (+) strand; PAM type: YTN; PAM sequence: TTC
tcttcccttcaaatcccagt

SEQ ID NO: 301732 - DNA, 20 bp, Artificial Sequence
  Description of Artificial Sequence: Synthetic oligonucleotide
  Target: ATXN1; (+) strand; PAM type: YTN; PAM sequence: CTC
ttcccttcaaatcccagtta

SEQ ID NO: 301733 - DNA, 20 bp, Artificial Sequence
  Description of Artificial Sequence: Synthetic oligonucleotide
  Target: ATXN1; (+) strand; PAM type: YTN; PAM sequence: CTT
cccttcaaatcccagttaag

SEQ ID NO: 301734 - DNA, 20 bp, Artificial Sequence
  Description of Artificial Sequence: Synthetic oligonucleotide
  Target: ATXN1; (+) strand; PAM type: YTN; PAM sequence: TTC
ccttcaaatcccagttaagg

SEQ ID NO: 301735 - DNA, 20 bp, Artificial Sequence
  Description of Artificial Sequence: Synthetic oligonucleotide
  Target: ATXN1; (+) strand; PAM type: YTN; PAM sequence: CTT
caaatcccagttaaggagac

SEQ ID NO: 301736 - DNA, 20 bp, Artificial Sequence
  Description of Artificial Sequence: Synthetic oligonucleotide
  Target: ATXN1; (+) strand; PAM type: YTN; PAM sequence: TTC
aaatcccagttaaggagacg

SEQ ID NO: 301737 - DNA, 20 bp, Artificial Sequence
  Description of Artificial Sequence: Synthetic oligonucleotide
  Target: ATXN1; (+) strand; PAM type: YTN; PAM sequence: TTA
aggagacgccatttagaata

SEQ ID NO: 301738 - DNA, 20 bp, Artificial Sequence
  Description of Artificial Sequence: Synthetic oligonucleotide
  Target: ATXN1; (+) strand; PAM type: YTN; PAM sequence: TTT
agaatatagctgttgattca

SEQ ID NO: 301739 - DNA, 20 bp, Artificial Sequence
  Description of Artificial Sequence: Synthetic oligonucleotide
  Target: ATXN1; (+) strand; PAM type: YTN; PAM sequence: TTA
gaatatagctgttgattcat

SEQ ID NO: 301740 - DNA, 20 bp, Artificial Sequence
  Description of Artificial Sequence: Synthetic oligonucleotide
  Target: ATXN1; (+) strand; PAM type: YTN; PAM sequence: CTG
ttgattcatctttttaacag

SEQ ID NO: 301741 - DNA, 20 bp, Artificial Sequence
  Description of Artificial Sequence: Synthetic oligonucleotide
  Target: ATXN1; (+) strand; PAM type: YTN; PAM sequence: TTG
attcatctttttaacagcac

SEQ ID NO: 301742 - DNA, 20 bp, Artificial Sequence
  Description of Artificial Sequence: Synthetic oligonucleotide
  Target: ATXN1; (+) strand; PAM type: YTN; PAM sequence: TTC
atctttttaacagcactctt

SEQ ID NO: 301743 - DNA, 20 bp, Artificial Sequence
  Description of Artificial Sequence: Synthetic oligonucleotide
  Target: ATXN1; (+) strand; PAM type: YTN; PAM sequence: CTT
tttaacagcactcttttttt

SEQ ID NO: 301744 - DNA, 20 bp, Artificial Sequence
  Description of Artificial Sequence: Synthetic oligonucleotide
  Target: ATXN1; (+) strand; PAM type: YTN; PAM sequence: TTT
ttaacagcactctttttttt

SEQ ID NO: 301745 - DNA, 20 bp, Artificial Sequence
  Description of Artificial Sequence: Synthetic oligonucleotide
  Target: ATXN1; (+) strand; PAM type: YTN; PAM sequence: TTT
taacagcactcttttttttt

SEQ ID NO: 301746 - DNA, 20 bp, Artificial Sequence
  Description of Artificial Sequence: Synthetic oligonucleotide
  Target: ATXN1; (+) strand; PAM type: YTN; PAM sequence: TTT
aacagcactctttttttttt

SEQ ID NO: 301747 - DNA, 20 bp, Artificial Sequence
  Description of Artificial Sequence: Synthetic oligonucleotide
  Target: ATXN1; (+) strand; PAM type: YTN; PAM sequence: TTA
acagcactcttttttttttg

SEQ ID NO: 301748 - DNA, 20 bp, Artificial Sequence
  Description of Artificial Sequence: Synthetic oligonucleotide
  Target: ATXN1; (+) strand; PAM type: YTN; PAM sequence: CTC
ttttttttttggtacaaaaa

SEQ ID NO: 301749 - DNA, 20 bp, Artificial Sequence
  Description of Artificial Sequence: Synthetic oligonucleotide
  Target: ATXN1; (+) strand; PAM type: YTN; PAM sequence: CTT
ttttttttggtacaaaaatc

SEQ ID NO: 301750 - DNA, 20 bp, Artificial Sequence
  Description of Artificial Sequence: Synthetic oligonucleotide
  Target: ATXN1; (+) strand; PAM type: YTN; PAM sequence: TTT
tttttttggtacaaaaatct

SEQ ID NO: 301751 - DNA, 20 bp, Artificial Sequence
  Description of Artificial Sequence: Synthetic oligonucleotide
  Target: ATXN1; (+) strand; PAM type: YTN; PAM sequence: TTT
ttttttggtacaaaaatctc

SEQ ID NO: 301752 - DNA, 20 bp, Artificial Sequence
  Description of Artificial Sequence: Synthetic oligonucleotide
  Target: ATXN1; (+) strand; PAM type: YTN; PAM sequence: TTT
tttttggtacaaaaatctct

SEQ ID NO: 301753 - DNA, 20 bp, Artificial Sequence
  Description of Artificial Sequence: Synthetic oligonucleotide
  Target: ATXN1; (+) strand; PAM type: YTN; PAM sequence: TTT
ttttggtacaaaaatctcta

SEQ ID NO: 301754 - DNA, 20 bp, Artificial Sequence
  Description of Artificial Sequence: Synthetic oligonucleotide
  Target: ATXN1; (+) strand; PAM type: YTN; PAM sequence: TTT
tttggtacaaaaatctctag

SEQ ID NO: 301755 - DNA, 20 bp, Artificial Sequence
  Description of Artificial Sequence: Synthetic oligonucleotide
  Target: ATXN1; (+) strand; PAM type: YTN; PAM sequence: TTT
ttggtacaaaaatctctagg

SEQ ID NO: 301756 - DNA, 20 bp, Artificial Sequence
  Description of Artificial Sequence: Synthetic oligonucleotide
  Target: ATXN1; (+) strand; PAM type: YTN; PAM sequence: TTT
tggtacaaaaatctctaggg

SEQ ID NO: 301757 - DNA, 20 bp, Artificial Sequence
  Description of Artificial Sequence: Synthetic oligonucleotide
  Target: ATXN1; (+) strand; PAM type: YTN; PAM sequence: TTT
ggtacaaaaatctctagggc

SEQ ID NO: 301758 - DNA, 20 bp, Artificial Sequence
  Description of Artificial Sequence: Synthetic oligonucleotide
  Target: ATXN1; (+) strand; PAM type: YTN; PAM sequence: TTG
gtacaaaaatctctagggct

SEQ ID NO: 301759 - DNA, 20 bp, Artificial Sequence
  Description of Artificial Sequence: Synthetic oligonucleotide
  Target: ATXN1; (+) strand; PAM type: YTN; PAM sequence: CTC
tagggcttttcttctttcca

SEQ ID NO: 301760 - DNA, 20 bp, Artificial Sequence
  Description of Artificial Sequence: Synthetic oligonucleotide
  Target: ATXN1; (+) strand; PAM type: YTN; PAM sequence: CTA
gggcttttcttctttccact

SEQ ID NO: 301761 - DNA, 20 bp, Artificial Sequence
  Description of Artificial Sequence: Synthetic oligonucleotide
  Target: ATXN1; (+) strand; PAM type: YTN; PAM sequence: CTT
ttcttctttccacttaaatc

SEQ ID NO: 301762 - DNA, 20 bp, Artificial Sequence
  Description of Artificial Sequence: Synthetic oligonucleotide
  Target: ATXN1; (+) strand; PAM type: YTN; PAM sequence: TTT
tcttctttccacttaaatcc

SEQ ID NO: 301763 - DNA, 20 bp, Artificial Sequence
  Description of Artificial Sequence: Synthetic oligonucleotide
  Target: ATXN1; (+) strand; PAM type: YTN; PAM sequence: TTT
cttctttccacttaaatcct

SEQ ID NO: 301764 - DNA, 20 bp, Artificial Sequence
  Description of Artificial Sequence: Synthetic oligonucleotide
  Target: ATXN1; (+) strand; PAM type: YTN; PAM sequence: TTC
ttctttccacttaaatcctt

SEQ ID NO: 301765 - DNA, 20 bp, Artificial Sequence
  Description of Artificial Sequence: Synthetic oligonucleotide
  Target: ATXN1; (+) strand; PAM type: YTN; PAM sequence: CTT
ctttccacttaaatcctttt

SEQ ID NO: 301766 - DNA, 20 bp, Artificial Sequence
  Description of Artificial Sequence: Synthetic oligonucleotide
  Target: ATXN1; (+) strand; PAM type: YTN; PAM sequence: TTC
tttccacttaaatccttttt

SEQ ID NO: 301767 - DNA, 20 bp, Artificial Sequence
  Description of Artificial Sequence: Synthetic oligonucleotide
  Target: ATXN1; (+) strand; PAM type: YTN; PAM sequence: CTT
tccacttaaatcctttttcc

SEQ ID NO: 301768 - DNA, 20 bp, Artificial Sequence
  Description of Artificial Sequence: Synthetic oligonucleotide
  Target: ATXN1; (+) strand; PAM type: YTN; PAM sequence: TTT
ccacttaaatcctttttccc

SEQ ID NO: 301769 - DNA, 20 bp, Artificial Sequence
  Description of Artificial Sequence: Synthetic oligonucleotide
  Target: ATXN1; (+) strand; PAM type: YTN; PAM sequence: TTC
cacttaaatcctttttccca

SEQ ID NO: 301770 - DNA, 20 bp, Artificial Sequence
  Description of Artificial Sequence: Synthetic oligonucleotide
  Target: ATXN1; (+) strand; PAM type: YTN; PAM sequence: CTT
aaatcctttttcccacccag

SEQ ID NO: 301771 - DNA, 20 bp, Artificial Sequence
  Description of Artificial Sequence: Synthetic oligonucleotide
  Target: ATXN1; (+) strand; PAM type: YTN; PAM sequence: TTA
aatcctttttcccacccagt

SEQ ID NO: 301772 - DNA, 20 bp, Artificial Sequence
  Description of Artificial Sequence: Synthetic oligonucleotide
  Target: ATXN1; (+) strand; PAM type: YTN; PAM sequence: CTT
tttcccacccagtgctctct

SEQ ID NO: 301773 - DNA, 20 bp, Artificial Sequence
  Description of Artificial Sequence: Synthetic oligonucleotide
  Target: ATXN1; (+) strand; PAM type: YTN; PAM sequence: TTT
ttcccacccagtgctctctg

SEQ ID NO: 301774 - DNA, 20 bp, Artificial Sequence
  Description of Artificial Sequence: Synthetic oligonucleotide
  Target: ATXN1; (+) strand; PAM type: YTN; PAM sequence: TTT
tcccacccagtgctctctga

SEQ ID NO: 301775 - DNA, 20 bp, Artificial Sequence
  Description of Artificial Sequence: Synthetic oligonucleotide
  Target: ATXN1; (+) strand; PAM type: YTN; PAM sequence: TTT
cccacccagtgctctctgaa

SEQ ID NO: 301776 - DNA, 20 bp, Artificial Sequence
  Description of Artificial Sequence: Synthetic oligonucleotide
  Target: ATXN1; (+) strand; PAM type: YTN; PAM sequence: TTC
ccacccagtgctctctgaag

SEQ ID NO: 301777 - DNA, 20 bp, Artificial Sequence
  Description of Artificial Sequence: Synthetic oligonucleotide
  Target: ATXN1; (+) strand; PAM type: YTN; PAM sequence: CTC
tctgaagagctaaggctaac

SEQ ID NO: 301778 - DNA, 20 bp, Artificial Sequence
  Description of Artificial Sequence: Synthetic oligonucleotide
  Target: ATXN1; (+) strand; PAM type: YTN; PAM sequence: CTC
tgaagagctaaggctaactt

SEQ ID NO: 301779 - DNA, 20 bp, Artificial Sequence
  Description of Artificial Sequence: Synthetic oligonucleotide
  Target: ATXN1; (+) strand; PAM type: YTN; PAM sequence: CTG
aagagctaaggctaactttt

SEQ ID NO: 301780 - DNA, 20 bp, Artificial Sequence
  Description of Artificial Sequence: Synthetic oligonucleotide
  Target: ATXN1; (+) strand; PAM type: YTN; PAM sequence: CTA
aggctaactttttccttttc

SEQ ID NO: 301781 - DNA, 20 bp, Artificial Sequence
  Description of Artificial Sequence: Synthetic oligonucleotide
  Target: ATXN1; (+) strand; PAM type: YTN; PAM sequence: CTA
actttttccttttctaaaga

SEQ ID NO: 301782 - DNA, 20 bp, Artificial Sequence
  Description of Artificial Sequence: Synthetic oligonucleotide
  Target: ATXN1; (+) strand; PAM type: YTN; PAM sequence: CTT
tttccttttctaaagatctt

SEQ ID NO: 301783 - DNA, 20 bp, Artificial Sequence
  Description of Artificial Sequence: Synthetic oligonucleotide
  Target: ATXN1; (+) strand; PAM type: YTN; PAM sequence: TTT
ttccttttctaaagatcttt

SEQ ID NO: 301784 - DNA, 20 bp, Artificial Sequence
  Description of Artificial Sequence: Synthetic oligonucleotide
  Target: ATXN1; (+) strand; PAM type: YTN; PAM sequence: TTT
tccttttctaaagatctttt

SEQ ID NO: 301785 - DNA, 20 bp, Artificial Sequence
  Description of Artificial Sequence: Synthetic oligonucleotide
  Target: ATXN1; (+) strand; PAM type: YTN; PAM sequence: TTT
ccttttctaaagatcttttt

SEQ ID NO: 301786 - DNA, 20 bp, Artificial Sequence
  Description of Artificial Sequence: Synthetic oligonucleotide
  Target: ATXN1; (+) strand; PAM type: YTN; PAM sequence: TTC
cttttctaaagatctttttt

SEQ ID NO: 301787 - DNA, 20 bp, Artificial Sequence
  Description of Artificial Sequence: Synthetic oligonucleotide
  Target: ATXN1; (+) strand; PAM type: YTN; PAM sequence: CTT
ttctaaagatcttttttttc

SEQ ID NO: 301788 - DNA, 20 bp, Artificial Sequence
  Description of Artificial Sequence: Synthetic oligonucleotide
  Target: ATXN1; (+) strand; PAM type: YTN; PAM sequence: TTT
tctaaagatcttttttttcc

SEQ ID NO: 301789 - DNA, 20 bp, Artificial Sequence
  Description of Artificial Sequence: Synthetic oligonucleotide
  Target: ATXN1; (+) strand; PAM type: YTN; PAM sequence: TTT
ctaaagatcttttttttcct

SEQ ID NO: 301790 - DNA, 20 bp, Artificial Sequence
  Description of Artificial Sequence: Synthetic oligonucleotide
  Target: ATXN1; (+) strand; PAM type: YTN; PAM sequence: TTC
taaagatcttttttttccta

SEQ ID NO: 301791 - DNA, 20 bp, Artificial Sequence
  Description of Artificial Sequence: Synthetic oligonucleotide
  Target: ATXN1; (+) strand; PAM type: YTN; PAM sequence: CTA
aagatcttttttttcctatg

SEQ ID NO: 301792 - DNA, 20 bp, Artificial Sequence
  Description of Artificial Sequence: Synthetic oligonucleotide
  Target: ATXN1; (+) strand; PAM type: YTN; PAM sequence: CTT
ttttttcctatgctgtttcc

SEQ ID NO: 301793 - DNA, 20 bp, Artificial Sequence
  Description of Artificial Sequence: Synthetic oligonucleotide
  Target: ATXN1; (+) strand; PAM type: YTN; PAM sequence: TTT
tttttcctatgctgtttccc

SEQ ID NO: 301794 - DNA, 20 bp, Artificial Sequence
  Description of Artificial Sequence: Synthetic oligonucleotide
  Target: ATXN1; (+) strand; PAM type: YTN; PAM sequence: TTT
ttttcctatgctgtttcccc

SEQ ID NO: 301795 - DNA, 20 bp, Artificial Sequence
  Description of Artificial Sequence: Synthetic oligonucleotide
  Target: ATXN1; (+) strand; PAM type: YTN; PAM sequence: TTT
tttcctatgctgtttcccca

SEQ ID NO: 301796 - DNA, 20 bp, Artificial Sequence
  Description of Artificial Sequence: Synthetic oligonucleotide
  Target: ATXN1; (+) strand; PAM type: YTN; PAM sequence: TTT
ttcctatgctgtttccccat

SEQ ID NO: 301797 - DNA, 20 bp, Artificial Sequence
  Description of Artificial Sequence: Synthetic oligonucleotide
  Target: ATXN1; (+) strand; PAM type: YTN; PAM sequence: TTT
tcctatgctgtttccccata

SEQ ID NO: 301798 - DNA, 20 bp, Artificial Sequence
  Description of Artificial Sequence: Synthetic oligonucleotide
  Target: ATXN1; (+) strand; PAM type: YTN; PAM sequence: TTT
cctatgctgtttccccatag

SEQ ID NO: 301799 - DNA, 20 bp, Artificial Sequence
  Description of Artificial Sequence: Synthetic oligonucleotide
  Target: ATXN1; (+) strand; PAM type: YTN; PAM sequence: TTC
ctatgctgtttccccatagt

SEQ ID NO: 301800 - DNA, 20 bp, Artificial Sequence
  Description of Artificial Sequence: Synthetic oligonucleotide
  Target: ATXN1; (+) strand; PAM type: YTN; PAM sequence: CTA
tgctgtttccccatagttcc

SEQ ID NO: 301801 - DNA, 20 bp, Artificial Sequence
  Description of Artificial Sequence: Synthetic oligonucleotide
  Target: ATXN1; (+) strand; PAM type: YTN; PAM sequence: CTG
tttccccatagttccacccg

SEQ ID NO: 301802 - DNA, 20 bp, Artificial Sequence
  Description of Artificial Sequence: Synthetic oligonucleotide
  Target: ATXN1; (+) strand; PAM type: YTN; PAM sequence: TTT
ccccatagttccacccgccc

SEQ ID NO: 301803 - DNA, 20 bp, Artificial Sequence
  Description of Artificial Sequence: Synthetic oligonucleotide
  Target: ATXN1; (+) strand; PAM type: YTN; PAM sequence: TTC
cccatagttccacccgcccc

SEQ ID NO: 301804 - DNA, 20 bp, Artificial Sequence
  Description of Artificial Sequence: Synthetic oligonucleotide
  Target: ATXN1; (+) strand; PAM type: YTN; PAM sequence: TTC
cacccgcccctcccccaccc

SEQ ID NO: 301805 - DNA, 20 bp, Artificial Sequence
  Description of Artificial Sequence: Synthetic oligonucleotide
  Target: ATXN1; (+) strand; PAM type: YTN; PAM sequence: CTC
ccccaccctcttcatgtctc

SEQ ID NO: 301806 - DNA, 20 bp, Artificial Sequence
  Description of Artificial Sequence: Synthetic oligonucleotide
  Target: ATXN1; (+) strand; PAM type: YTN; PAM sequence: CTC
ttcatgtctcatataaaaac

SEQ ID NO: 301807 - DNA, 20 bp, Artificial Sequence
  Description of Artificial Sequence: Synthetic oligonucleotide
  Target: ATXN1; (+) strand; PAM type: YTN; PAM sequence: CTT
catgtctcatataaaaacag

SEQ ID NO: 301808 - DNA, 20 bp, Artificial Sequence
  Description of Artificial Sequence: Synthetic oligonucleotide
  Target: ATXN1; (+) strand; PAM type: YTN; PAM sequence: TTC
atgtctcatataaaaacagc

SEQ ID NO: 301809 - DNA, 20 bp, Artificial Sequence
  Description of Artificial Sequence: Synthetic oligonucleotide
  Target: ATXN1; (+) strand; PAM type: YTN; PAM sequence: CTC
atataaaaacagcactctca

SEQ ID NO: 301810 - DNA, 20 bp, Artificial Sequence
  Description of Artificial Sequence: Synthetic oligonucleotide
  Target: ATXN1; (+) strand; PAM type: YTN; PAM sequence: CTC
tcactgggcttaatccccaa

SEQ ID NO: 301811 - DNA, 20 bp, Artificial Sequence
  Description of Artificial Sequence: Synthetic oligonucleotide
  Target: ATXN1; (+) strand; PAM type: YTN; PAM sequence: CTC
actgggcttaatccccaaat

SEQ ID NO: 301812 - DNA, 20 bp, Artificial Sequence
  Description of Artificial Sequence: Synthetic oligonucleotide
  Target: ATXN1; (+) strand; PAM type: YTN; PAM sequence: CTG
ggcttaatccccaaatgttt

SEQ ID NO: 301813 - DNA, 20 bp, Artificial Sequence
  Description of Artificial Sequence: Synthetic oligonucleotide
  Target: ATXN1; (+) strand; PAM type: YTN; PAM sequence: CTT
aatccccaaatgtttttaat

SEQ ID NO: 301814 - DNA, 20 bp, Artificial Sequence
  Description of Artificial Sequence: Synthetic oligonucleotide
  Target: ATXN1; (+) strand; PAM type: YTN; PAM sequence: TTA
atccccaaatgtttttaatt

SEQ ID NO: 301815 - DNA, 20 bp, Artificial Sequence
  Description of Artificial Sequence: Synthetic oligonucleotide
  Target: ATXN1; (+) strand; PAM type: YTN; PAM sequence: TTT
ttaattgactcatttggtga

SEQ ID NO: 301816 - DNA, 20 bp, Artificial Sequence
  Description of Artificial Sequence: Synthetic oligonucleotide
  Target: ATXN1; (+) strand; PAM type: YTN; PAM sequence: TTT
taattgactcatttggtgag

SEQ ID NO: 301817 - DNA, 20 bp, Artificial Sequence
  Description of Artificial Sequence: Synthetic oligonucleotide
  Target: ATXN1; (+) strand; PAM type: YTN; PAM sequence: TTT
aattgactcatttggtgagg

SEQ ID NO: 301818 - DNA, 20 bp, Artificial Sequence
  Description of Artificial Sequence: Synthetic oligonucleotide
  Target: ATXN1; (+) strand; PAM type: YTN; PAM sequence: TTA
attgactcatttggtgaggc

SEQ ID NO: 301819 - DNA, 20 bp, Artificial Sequence
  Description of Artificial Sequence: Synthetic oligonucleotide
  Target: ATXN1; (+) strand; PAM type: YTN; PAM sequence: TTG
actcatttggtgaggctctc

SEQ ID NO: 301820 - DNA, 20 bp, Artificial Sequence
  Description of Artificial Sequence: Synthetic oligonucleotide
  Target: ATXN1; (+) strand; PAM type: YTN; PAM sequence: CTC
atttggtgaggctctcccta

SEQ ID NO: 301821 - DNA, 20 bp, Artificial Sequence
  Description of Artificial Sequence: Synthetic oligonucleotide
  Target: ATXN1; (+) strand; PAM type: YTN; PAM sequence: TTT
ggtgaggctctccctagcta

SEQ ID NO: 301822 - DNA, 20 bp, Artificial Sequence
  Description of Artificial Sequence: Synthetic oligonucleotide
  Target: ATXN1; (+) strand; PAM type: YTN; PAM sequence: TTG
gtgaggctctccctagctaa

SEQ ID NO: 301823 - DNA, 20 bp, Artificial Sequence
  Description of Artificial Sequence: Synthetic oligonucleotide
  Target: ATXN1; (+) strand; PAM type: YTN; PAM sequence: CTC
tccctagctaaatgaacagt

SEQ ID NO: 301824 - DNA, 20 bp, Artificial Sequence
  Description of Artificial Sequence: Synthetic oligonucleotide
  Target: ATXN1; (+) strand; PAM type: YTN; PAM sequence: CTC
cctagctaaatgaacagtct

SEQ ID NO: 301825 - DNA, 20 bp, Artificial Sequence
  Description of Artificial Sequence: Synthetic oligonucleotide
  Target: ATXN1; (+) strand; PAM type: YTN; PAM sequence: CTA
gctaaatgaacagtctgcct

SEQ ID NO: 301826 - DNA, 20 bp, Artificial Sequence
  Description of Artificial Sequence: Synthetic oligonucleotide
  Target: ATXN1; (+) strand; PAM type: YTN; PAM sequence: CTA
aatgaacagtctgccttttc

SEQ ID NO: 301827 - DNA, 20 bp, Artificial Sequence
  Description of Artificial Sequence: Synthetic oligonucleotide
  Target: ATXN1; (+) strand; PAM type: YTN; PAM sequence: CTG
ccttttcaaaggaaccaaac

SEQ ID NO: 301828 - DNA, 20 bp, Artificial Sequence
  Description of Artificial Sequence: Synthetic oligonucleotide
  Target: ATXN1; (+) strand; PAM type: YTN; PAM sequence: CTT
ttcaaaggaaccaaacattt

SEQ ID NO: 301829 - DNA, 20 bp, Artificial Sequence
  Description of Artificial Sequence: Synthetic oligonucleotide
  Target: ATXN1; (+) strand; PAM type: YTN; PAM sequence: TTT
tcaaaggaaccaaacatttc

SEQ ID NO: 301830 - DNA, 20 bp, Artificial Sequence
  Description of Artificial Sequence: Synthetic oligonucleotide
  Target: ATXN1; (+) strand; PAM type: YTN; PAM sequence: TTT
caaaggaaccaaacatttct

SEQ ID NO: 301831 - DNA, 20 bp, Artificial Sequence
  Description of Artificial Sequence: Synthetic oligonucleotide
  Target: ATXN1; (+) strand; PAM type: YTN; PAM sequence: TTC
aaaggaaccaaacatttctt

SEQ ID NO: 301832 - DNA, 20 bp, Artificial Sequence
  Description of Artificial Sequence: Synthetic oligonucleotide
  Target: ATXN1; (+) strand; PAM type: YTN; PAM sequence: TTT
cttccttctgagtattttaa

SEQ ID NO: 301833 - DNA, 20 bp, Artificial Sequence
  Description of Artificial Sequence: Synthetic oligonucleotide
  Target: ATXN1; (+) strand; PAM type: YTN; PAM sequence: TTC
ttccttctgagtattttaaa

SEQ ID NO: 301834 - DNA, 20 bp, Artificial Sequence
  Description of Artificial Sequence: Synthetic oligonucleotide
  Target: ATXN1; (+) strand; PAM type: YTN; PAM sequence: CTT
ccttctgagtattttaaact

SEQ ID NO: 301835 - DNA, 20 bp, Artificial Sequence
  Description of Artificial Sequence: Synthetic oligonucleotide
  Target: ATXN1; (+) strand; PAM type: YTN; PAM sequence: TTC
cttctgagtattttaaactc

SEQ ID NO: 301836 - DNA, 20 bp, Artificial Sequence
  Description of Artificial Sequence: Synthetic oligonucleotide
  Target: ATXN1; (+) strand; PAM type: YTN; PAM sequence: CTT
ctgagtattttaaactcttc

SEQ ID NO: 301837 - DNA, 20 bp, Artificial Sequence
  Description of Artificial Sequence: Synthetic oligonucleotide
  Target: ATXN1; (+) strand; PAM type: YTN; PAM sequence: TTC
tgagtattttaaactcttct

SEQ ID NO: 301838 - DNA, 20 bp, Artificial Sequence
  Description of Artificial Sequence: Synthetic oligonucleotide
  Target: ATXN1; (+) strand; PAM type: YTN; PAM sequence: CTG
agtattttaaactcttctaa

SEQ ID NO: 301839 - DNA, 20 bp, Artificial Sequence
  Description of Artificial Sequence: Synthetic oligonucleotide
  Target: ATXN1; (+) strand; PAM type: YTN; PAM sequence: TTT
taaactcttctaacaaagcc

SEQ ID NO: 301840 - DNA, 20 bp, Artificial Sequence
  Description of Artificial Sequence: Synthetic oligonucleotide
  Target: ATXN1; (+) strand; PAM type: YTN; PAM sequence: TTT
aaactcttctaacaaagcca

SEQ ID NO: 301841 - DNA, 20 bp, Artificial Sequence
  Description of Artificial Sequence: Synthetic oligonucleotide
  Target: ATXN1; (+) strand; PAM type: YTN; PAM sequence: TTA
aactcttctaacaaagccaa

SEQ ID NO: 301842 - DNA, 20 bp, Artificial Sequence
  Description of Artificial Sequence: Synthetic oligonucleotide
  Target: ATXN1; (+) strand; PAM type: YTN; PAM sequence: CTC
ttctaacaaagccaaacatg

SEQ ID NO: 301843 - DNA, 20 bp, Artificial Sequence
  Description of Artificial Sequence: Synthetic oligonucleotide
  Target: ATXN1; (+) strand; PAM type: YTN; PAM sequence: CTT
ctaacaaagccaaacatgga

SEQ ID NO: 301844 - DNA, 20 bp, Artificial Sequence
  Description of Artificial Sequence: Synthetic oligonucleotide
  Target: ATXN1; (+) strand; PAM type: YTN; PAM sequence: TTC
taacaaagccaaacatggat

SEQ ID NO: 301845 - DNA, 20 bp, Artificial Sequence
  Description of Artificial Sequence: Synthetic oligonucleotide
  Target: ATXN1; (+) strand; PAM type: YTN; PAM sequence: CTA
acaaagccaaacatggatta

SEQ ID NO: 301846 - DNA, 20 bp, Artificial Sequence
  Description of Artificial Sequence: Synthetic oligonucleotide
  Target: ATXN1; (+) strand; PAM type: YTN; PAM sequence: TTA
aacagcgttacataagtctc

SEQ ID NO: 301847 - DNA, 20 bp, Artificial Sequence
  Description of Artificial Sequence: Synthetic oligonucleotide
  Target: ATXN1; (+) strand; PAM type: YTN; PAM sequence: TTA
cataagtctcttcacagcac

SEQ ID NO: 301848 - DNA, 20 bp, Artificial Sequence
  Description of Artificial Sequence: Synthetic oligonucleotide
  Target: ATXN1; (+) strand; PAM type: YTN; PAM sequence: CTC
ttcacagcacctaagttcaa

SEQ ID NO: 301849 - DNA, 20 bp, Artificial Sequence
  Description of Artificial Sequence: Synthetic oligonucleotide
  Target: ATXN1; (+) strand; PAM type: YTN; PAM sequence: CTT
cacagcacctaagttcaaat

SEQ ID NO: 301850 - DNA, 20 bp, Artificial Sequence
  Description of Artificial Sequence: Synthetic oligonucleotide
  Target: ATXN1; (+) strand; PAM type: YTN; PAM sequence: TTC
acagcacctaagttcaaatt

SEQ ID NO: 301851 - DNA, 20 bp, Artificial Sequence
  Description of Artificial Sequence: Synthetic oligonucleotide
  Target: ATXN1; (+) strand; PAM type: YTN; PAM sequence: CTA
agttcaaattaggaatcaag

SEQ ID NO: 301852 - DNA, 20 bp, Artificial Sequence
  Description of Artificial Sequence: Synthetic oligonucleotide
  Target: ATXN1; (+) strand; PAM type: YTN; PAM sequence: TTC
aaattaggaatcaagtccca

SEQ ID NO: 301853 - DNA, 20 bp, Artificial Sequence
  Description of Artificial Sequence: Synthetic oligonucleotide
  Target: ATXN1; (+) strand; PAM type: YTN; PAM sequence: TTA
ggaatcaagtcccaataacc

SEQ ID NO: 301854 - DNA, 20 bp, Artificial Sequence
  Description of Artificial Sequence: Synthetic oligonucleotide
  Target: ATXN1; (+) strand; PAM type: YTN; PAM sequence: CTG
ttttcaccaataaatagcca

SEQ ID NO: 301855 - DNA, 20 bp, Artificial Sequence
  Description of Artificial Sequence: Synthetic oligonucleotide
  Target: ATXN1; (+) strand; PAM type: YTN; PAM sequence: TTT
tcaccaataaatagccaccc

SEQ ID NO: 301856 - DNA, 20 bp, Artificial Sequence
  Description of Artificial Sequence: Synthetic oligonucleotide
  Target: ATXN1; (+) strand; PAM type: YTN; PAM sequence: TTT
caccaataaatagccacccc

SEQ ID NO: 301857 - DNA, 20 bp, Artificial Sequence
  Description of Artificial Sequence: Synthetic oligonucleotide
  Target: ATXN1; (+) strand; PAM type: YTN; PAM sequence: TTC
accaataaatagccacccca

SEQ ID NO: 301858 - DNA, 20 bp, Artificial Sequence
  Description of Artificial Sequence: Synthetic oligonucleotide
  Target: ATXN1; (+) strand; PAM type: YTN; PAM sequence: CTG
ccccatcgactaggaagagg

SEQ ID NO: 301859 - DNA, 20 bp, Artificial Sequence
  Description of Artificial Sequence: Synthetic oligonucleotide
  Target: ATXN1; (+) strand; PAM type: YTN; PAM sequence: CTA
ggaagaggcccactcaggca

SEQ ID NO: 301860 - DNA, 20 bp, Artificial Sequence
  Description of Artificial Sequence: Synthetic oligonucleotide
  Target: ATXN1; (+) strand; PAM type: YTN; PAM sequence: CTC
aggcacccggaagctttgcc

SEQ ID NO: 301861 - DNA, 20 bp, Artificial Sequence
  Description of Artificial Sequence: Synthetic oligonucleotide
  Target: ATXN1; (+) strand; PAM type: YTN; PAM sequence: CTT
tgccccagagagcagaatga

SEQ ID NO: 301862 - DNA, 20 bp, Artificial Sequence
  Description of Artificial Sequence: Synthetic oligonucleotide
  Target: ATXN1; (+) strand; PAM type: YTN; PAM sequence: TTT
gccccagagagcagaatgag

SEQ ID NO: 301863 - DNA, 20 bp, Artificial Sequence
  Description of Artificial Sequence: Synthetic oligonucleotide
  Target: ATXN1; (+) strand; PAM type: YTN; PAM sequence: TTG
ccccagagagcagaatgagg

SEQ ID NO: 301864 - DNA, 20 bp, Artificial Sequence
  Description of Artificial Sequence: Synthetic oligonucleotide
  Target: ATXN1; (+) strand; PAM type: YTN; PAM sequence: CTT
cctgaaactataccactgct

SEQ ID NO: 301865 - DNA, 20 bp, Artificial Sequence
  Description of Artificial Sequence: Synthetic oligonucleotide
  Target: ATXN1; (+) strand; PAM type: YTN; PAM sequence: TTC
ctgaaactataccactgctc

SEQ ID NO: 301866 - DNA, 20 bp, Artificial Sequence
  Description of Artificial Sequence: Synthetic oligonucleotide
  Target: ATXN1; (+) strand; PAM type: YTN; PAM sequence: CTG
aaactataccactgctctgc

SEQ ID NO: 301867 - DNA, 20 bp, Artificial Sequence
  Description of Artificial Sequence: Synthetic oligonucleotide
  Target: ATXN1; (+) strand; PAM type: YTN; PAM sequence: CTA
taccactgctctgcagacat

SEQ ID NO: 301868 - DNA, 20 bp, Artificial Sequence
  Description of Artificial Sequence: Synthetic oligonucleotide
  Target: ATXN1; (+) strand; PAM type: YTN; PAM sequence: CTG
ctctgcagacatatctcacc

SEQ ID NO: 301869 - DNA, 20 bp, Artificial Sequence
  Description of Artificial Sequence: Synthetic oligonucleotide
  Target: ATXN1; (+) strand; PAM type: YTN; PAM sequence: CTC
tgcagacatatctcacccac

SEQ ID NO: 301870 - DNA, 20 bp, Artificial Sequence
  Description of Artificial Sequence: Synthetic oligonucleotide
  Target: ATXN1; (+) strand; PAM type: YTN; PAM sequence: CTG
cagacatatctcacccacag

SEQ ID NO: 301871 - DNA, 20 bp, Artificial Sequence
  Description of Artificial Sequence: Synthetic oligonucleotide
  Target: ATXN1; (+) strand; PAM type: YTN; PAM sequence: CTC
acccacagtgctttcctatt

SEQ ID NO: 301872 - DNA, 20 bp, Artificial Sequence
  Description of Artificial Sequence: Synthetic oligonucleotide
  Target: ATXN1; (+) strand; PAM type: YTN; PAM sequence: CTT
tcctattgccaggagcaccg

SEQ ID NO: 301873 - DNA, 20 bp, Artificial Sequence
  Description of Artificial Sequence: Synthetic oligonucleotide
  Target: ATXN1; (+) strand; PAM type: YTN; PAM sequence: TTT
cctattgccaggagcaccgg

SEQ ID NO: 301874 - DNA, 20 bp, Artificial Sequence
  Description of Artificial Sequence: Synthetic oligonucleotide
  Target: ATXN1; (+) strand; PAM type: YTN; PAM sequence: TTC
ctattgccaggagcaccggg

SEQ ID NO: 301875 - DNA, 20 bp, Artificial Sequence
  Description of Artificial Sequence: Synthetic oligonucleotide
  Target: ATXN1; (+) strand; PAM type: YTN; PAM sequence: CTA
ttgccaggagcaccgggagg

SEQ ID NO: 301876 - DNA, 20 bp, Artificial Sequence
  Description of Artificial Sequence: Synthetic oligonucleotide
  Target: ATXN1; (+) strand; PAM type: YTN; PAM sequence: TTG
ccaggagcaccgggagggaa

SEQ ID NO: 301877 - DNA, 20 bp, Artificial Sequence
  Description of Artificial Sequence: Synthetic oligonucleotide
  Target: ATXN1; (+) strand; PAM type: YTN; PAM sequence: TTT
gcccattctaatcatccctt

SEQ ID NO: 301878 - DNA, 20 bp, Artificial Sequence
  Description of Artificial Sequence: Synthetic oligonucleotide
  Target: ATXN1; (+) strand; PAM type: YTN; PAM sequence: TTG
cccattctaatcatcccttc

SEQ ID NO: 301879 - DNA, 20 bp, Artificial Sequence
  Description of Artificial Sequence: Synthetic oligonucleotide
  Target: ATXN1; (+) strand; PAM type: YTN; PAM sequence: TTC
taatcatcccttctaatggc

SEQ ID NO: 301880 - DNA, 20 bp, Artificial Sequence
  Description of Artificial Sequence: Synthetic oligonucleotide
  Target: ATXN1; (+) strand; PAM type: YTN; PAM sequence: CTA
atcatcccttctaatggcgc

SEQ ID NO: 301881 - DNA, 20 bp, Artificial Sequence
  Description of Artificial Sequence: Synthetic oligonucleotide
  Target: ATXN1; (+) strand; PAM type: YTN; PAM sequence: CTT
ctaatggcgcagcaagagat

SEQ ID NO: 301882 - DNA, 20 bp, Artificial Sequence
  Description of Artificial Sequence: Synthetic oligonucleotide
  Target: ATXN1; (+) strand; PAM type: YTN; PAM sequence: TTC
taatggcgcagcaagagatc

SEQ ID NO: 301883 - DNA, 20 bp, Artificial Sequence
  Description of Artificial Sequence: Synthetic oligonucleotide
  Target: ATXN1; (+) strand; PAM type: YTN; PAM sequence: CTA
atggcgcagcaagagatcat

SEQ ID NO: 301884 - DNA, 20 bp, Artificial Sequence
  Description of Artificial Sequence: Synthetic oligonucleotide
  Target: ATXN1; (+) strand; PAM type: YTN; PAM sequence: CTA
ctctgtggttaacttttcac

SEQ ID NO: 301885 - DNA, 20 bp, Artificial Sequence
  Description of Artificial Sequence: Synthetic oligonucleotide
  Target: ATXN1; (+) strand; PAM type: YTN; PAM sequence: CTC
tgtggttaacttttcacctg

SEQ ID NO: 301886 - DNA, 20 bp, Artificial Sequence
  Description of Artificial Sequence: Synthetic oligonucleotide
  Target: ATXN1; (+) strand; PAM type: YTN; PAM sequence: CTG
tggttaacttttcacctgta

SEQ ID NO: 301887 - DNA, 20 bp, Artificial Sequence
  Description of Artificial Sequence: Synthetic oligonucleotide
  Target: ATXN1; (+) strand; PAM type: YTN; PAM sequence: TTA
acttttcacctgtattgtga

SEQ ID NO: 301888 - DNA, 20 bp, Artificial Sequence
  Description of Artificial Sequence: Synthetic oligonucleotide
  Target: ATXN1; (+) strand; PAM type: YTN; PAM sequence: CTT
ttcacctgtattgtgaatta

SEQ ID NO: 301889 - DNA, 20 bp, Artificial Sequence
  Description of Artificial Sequence: Synthetic oligonucleotide
  Target: ATXN1; (+) strand; PAM type: YTN; PAM sequence: TTT
tcacctgtattgtgaattaa

SEQ ID NO: 301890 - DNA, 20 bp, Artificial Sequence
  Description of Artificial Sequence: Synthetic oligonucleotide
  Target: ATXN1; (+) strand; PAM type: YTN; PAM sequence: TTT
cacctgtattgtgaattaac

SEQ ID NO: 301891 - DNA, 20 bp, Artificial Sequence
  Description of Artificial Sequence: Synthetic oligonucleotide
  Target: ATXN1; (+) strand; PAM type: YTN; PAM sequence: TTC
acctgtattgtgaattaact

SEQ ID NO: 301892 - DNA, 20 bp, Artificial Sequence
  Description of Artificial Sequence: Synthetic oligonucleotide
  Target: ATXN1; (+) strand; PAM type: YTN; PAM sequence: CTG
tattgtgaattaactacact

SEQ ID NO: 301893 - DNA, 20 bp, Artificial Sequence
  Description of Artificial Sequence: Synthetic oligonucleotide
  Target: ATXN1; (+) strand; PAM type: YTN; PAM sequence: TTG
tgaattaactacactcatta

SEQ ID NO: 301894 - DNA, 20 bp, Artificial Sequence
  Description of Artificial Sequence: Synthetic oligonucleotide
  Target: ATXN1; (+) strand; PAM type: YTN; PAM sequence: TTA
actacactcattattcattt

SEQ ID NO: 301895 - DNA, 20 bp, Artificial Sequence
  Description of Artificial Sequence: Synthetic oligonucleotide
  Target: ATXN1; (+) strand; PAM type: YTN; PAM sequence: CTA
cactcattattcatttaaac

SEQ ID NO: 301896 - DNA, 20 bp, Artificial Sequence
  Description of Artificial Sequence: Synthetic oligonucleotide
  Target: ATXN1; (+) strand; PAM type: YTN; PAM sequence: CTC
attattcatttaaacagcac

SEQ ID NO: 301897 - DNA, 20 bp, Artificial Sequence
  Description of Artificial Sequence: Synthetic oligonucleotide
  Target: ATXN1; (+) strand; PAM type: YTN; PAM sequence: TTA
ttcatttaaacagcacctaa

SEQ ID NO: 301898 - DNA, 20 bp, Artificial Sequence
  Description of Artificial Sequence: Synthetic oligonucleotide
  Target: ATXN1; (+) strand; PAM type: YTN; PAM sequence: TTC
atttaaacagcacctaaaga

SEQ ID NO: 301899 - DNA, 20 bp, Artificial Sequence
  Description of Artificial Sequence: Synthetic oligonucleotide
  Target: ATXN1; (+) strand; PAM type: YTN; PAM sequence: TTT
aaacagcacctaaagaacct

SEQ ID NO: 301900 - DNA, 20 bp, Artificial Sequence
  Description of Artificial Sequence: Synthetic oligonucleotide
  Target: ATXN1; (+) strand; PAM type: YTN; PAM sequence: TTA
aacagcacctaaagaacctt

SEQ ID NO: 301901 - DNA, 20 bp, Artificial Sequence
  Description of Artificial Sequence: Synthetic oligonucleotide
  Target: ATXN1; (+) strand; PAM type: YTN; PAM sequence: CTA
aagaaccttcaagtctaaac

SEQ ID NO: 301902 - DNA, 20 bp, Artificial Sequence
  Description of Artificial Sequence: Synthetic oligonucleotide
  Target: ATXN1; (+) strand; PAM type: YTN; PAM sequence: CTT
caagtctaaacacatcactc

SEQ ID NO: 301903 - DNA, 20 bp, Artificial Sequence
  Description of Artificial Sequence: Synthetic oligonucleotide
  Target: ATXN1; (+) strand; PAM type: YTN; PAM sequence: TTC
aagtctaaacacatcactct

SEQ ID NO: 301904 - DNA, 20 bp, Artificial Sequence
  Description of Artificial Sequence: Synthetic oligonucleotide
  Target: ATXN1; (+) strand; PAM type: YTN; PAM sequence: CTA
aacacatcactctatcatta

SEQ ID NO: 301905 - DNA, 20 bp, Artificial Sequence
  Description of Artificial Sequence: Synthetic oligonucleotide
  Target: ATXN1; (+) strand; PAM type: YTN; PAM sequence: CTC
tatcattagtgactgttgct

SEQ ID NO: 301906 - DNA, 20 bp, Artificial Sequence
  Description of Artificial Sequence: Synthetic oligonucleotide
  Target: ATXN1; (+) strand; PAM type: YTN; PAM sequence: CTA
tcattagtgactgttgctga

SEQ ID NO: 301907 - DNA, 20 bp, Artificial Sequence
  Description of Artificial Sequence: Synthetic oligonucleotide
  Target: ATXN1; (+) strand; PAM type: YTN; PAM sequence: TTA
gtgactgttgctgaagaagg

SEQ ID NO: 301908 - DNA, 20 bp, Artificial Sequence
  Description of Artificial Sequence: Synthetic oligonucleotide
  Target: ATXN1; (+) strand; PAM type: YTN; PAM sequence: CTG
ttgctgaagaagggcttcac

SEQ ID NO: 301909 - DNA, 20 bp, Artificial Sequence
  Description of Artificial Sequence: Synthetic oligonucleotide
  Target: ATXN1; (+) strand; PAM type: YTN; PAM sequence: TTG
ctgaagaagggcttcactga

SEQ ID NO: 301910 - DNA, 20 bp, Artificial Sequence
  Description of Artificial Sequence: Synthetic oligonucleotide
  Target: ATXN1; (+) strand; PAM type: YTN; PAM sequence: CTG
aagaagggcttcactgaaat

SEQ ID NO: 301911 - DNA, 20 bp, Artificial Sequence
  Description of Artificial Sequence: Synthetic oligonucleotide
  Target: ATXN1; (+) strand; PAM type: YTN; PAM sequence: CTT
cactgaaatatgattgtatt

SEQ ID NO: 301912 - DNA, 20 bp, Artificial Sequence
  Description of Artificial Sequence: Synthetic oligonucleotide
  Target: ATXN1; (+) strand; PAM type: YTN; PAM sequence: TTC
actgaaatatgattgtatta

SEQ ID NO: 301913 - DNA, 20 bp, Artificial Sequence
  Description of Artificial Sequence: Synthetic oligonucleotide
  Target: ATXN1; (+) strand; PAM type: YTN; PAM sequence: CTG
aaatatgattgtattaacat

SEQ ID NO: 301914 - DNA, 20 bp, Artificial Sequence
  Description of Artificial Sequence: Synthetic oligonucleotide
  Target: ATXN1; (+) strand; PAM type: YTN; PAM sequence: TTG
tattaacatgtgaggaagct

SEQ ID NO: 301915 - DNA, 20 bp, Artificial Sequence
  Description of Artificial Sequence: Synthetic oligonucleotide
  Target: ATXN1; (+) strand; PAM type: YTN; PAM sequence: TTA
acatgtgaggaagctgaaat

SEQ ID NO: 301916 - DNA, 20 bp, Artificial Sequence
  Description of Artificial Sequence: Synthetic oligonucleotide
  Target: ATXN1; (+) strand; PAM type: YTN; PAM sequence: CTG
aaatgaattttctttagagc

SEQ ID NO: 301917 - DNA, 20 bp, Artificial Sequence
  Description of Artificial Sequence: Synthetic oligonucleotide
  Target: ATXN1; (+) strand; PAM type: YTN; PAM sequence: TTT
tctttagagcagctcatagt

SEQ ID NO: 301918 - DNA, 20 bp, Artificial Sequence
  Description of Artificial Sequence: Synthetic oligonucleotide
  Target: ATXN1; (+) strand; PAM type: YTN; PAM sequence: TTT
ctttagagcagctcatagta

SEQ ID NO: 301919 - DNA, 20 bp, Artificial Sequence
  Description of Artificial Sequence: Synthetic oligonucleotide
  Target: ATXN1; (+) strand; PAM type: YTN; PAM sequence: TTC
tttagagcagctcatagtac

SEQ ID NO: 301920 - DNA, 20 bp, Artificial Sequence
  Description of Artificial Sequence: Synthetic oligonucleotide
  Target: ATXN1; (+) strand; PAM type: YTN; PAM sequence: CTT
tagagcagctcatagtacca

SEQ ID NO: 301921 - DNA, 20 bp, Artificial Sequence
  Description of Artificial Sequence: Synthetic oligonucleotide
  Target: ATXN1; (+) strand; PAM type: YTN; PAM sequence: TTT
agagcagctcatagtaccaa

SEQ ID NO: 301922 - DNA, 20 bp, Artificial Sequence
  Description of Artificial Sequence: Synthetic oligonucleotide
  Target: ATXN1; (+) strand; PAM type: YTN; PAM sequence: TTA
gagcagctcatagtaccaac

SEQ ID NO: 301923 - DNA, 20 bp, Artificial Sequence
  Description of Artificial Sequence: Synthetic oligonucleotide
  Target: ATXN1; (+) strand; PAM type: YTN; PAM sequence: CTC
atagtaccaaccactccctg

SEQ ID NO: 301924 - DNA, 20 bp, Artificial Sequence
  Description of Artificial Sequence: Synthetic oligonucleotide
  Target: ATXN1; (+) strand; PAM type: YTN; PAM sequence: CTC
cctgcccctcccattctcac

SEQ ID NO: 301925 - DNA, 20 bp, Artificial Sequence
  Description of Artificial Sequence: Synthetic oligonucleotide
  Target: ATXN1; (+) strand; PAM type: YTN; PAM sequence: CTG
cccctcccattctcactccc

SEQ ID NO: 301926 - DNA, 20 bp, Artificial Sequence
  Description of Artificial Sequence: Synthetic oligonucleotide
  Target: ATXN1; (+) strand; PAM type: YTN; PAM sequence: CTC
ccattctcactcccagtagc

SEQ ID NO: 301927 - DNA, 20 bp, Artificial Sequence
  Description of Artificial Sequence: Synthetic oligonucleotide
  Target: ATXN1; (+) strand; PAM type: YTN; PAM sequence: TTC
tcactcccagtagctgggag

SEQ ID NO: 301928 - DNA, 20 bp, Artificial Sequence
  Description of Artificial Sequence: Synthetic oligonucleotide
  Target: ATXN1; (+) strand; PAM type: YTN; PAM sequence: CTC
actcccagtagctgggagat

SEQ ID NO: 301929 - DNA, 20 bp, Artificial Sequence
  Description of Artificial Sequence: Synthetic oligonucleotide
  Target: ATXN1; (+) strand; PAM type: YTN; PAM sequence: CTC
ccagtagctgggagatgatg

SEQ ID NO: 301930 - DNA, 20 bp, Artificial Sequence
  Description of Artificial Sequence: Synthetic oligonucleotide
  Target: ATXN1; (+) strand; PAM type: YTN; PAM sequence: CTG
ggagatgatgcttcattgtt

SEQ ID NO: 301931 - DNA, 20 bp, Artificial Sequence
  Description of Artificial Sequence: Synthetic oligonucleotide
  Target: ATXN1; (+) strand; PAM type: YTN; PAM sequence: CTT
cattgttctaagcttagact

SEQ ID NO: 301932 - DNA, 20 bp, Artificial Sequence
  Description of Artificial Sequence: Synthetic oligonucleotide
  Target: ATXN1; (+) strand; PAM type: YTN; PAM sequence: TTC
attgttctaagcttagactt

SEQ ID NO: 301933 - DNA, 20 bp, Artificial Sequence
  Description of Artificial Sequence: Synthetic oligonucleotide
  Target: ATXN1; (+) strand; PAM type: YTN; PAM sequence: TTG
ttctaagcttagacttaata

SEQ ID NO: 301934 - DNA, 20 bp, Artificial Sequence
  Description of Artificial Sequence: Synthetic oligonucleotide
  Target: ATXN1; (+) strand; PAM type: YTN; PAM sequence: TTC
taagcttagacttaatacaa

SEQ ID NO: 301935 - DNA, 20 bp, Artificial Sequence
  Description of Artificial Sequence: Synthetic oligonucleotide
  Target: ATXN1; (+) strand; PAM type: YTN; PAM sequence: CTA
agcttagacttaatacaaca

SEQ ID NO: 301936 - DNA, 20 bp, Artificial Sequence
  Description of Artificial Sequence: Synthetic oligonucleotide
  Target: ATXN1; (+) strand; PAM type: YTN; PAM sequence: CTT
agacttaatacaacactgca

SEQ ID NO: 301937 - DNA, 20 bp, Artificial Sequence
  Description of Artificial Sequence: Synthetic oligonucleotide
  Target: ATXN1; (+) strand; PAM type: YTN; PAM sequence: TTA
gacttaatacaacactgcac

SEQ ID NO: 301938 - DNA, 20 bp, Artificial Sequence
  Description of Artificial Sequence: Synthetic oligonucleotide
  Target: ATXN1; (+) strand; PAM type: YTN; PAM sequence: CTT
aatacaacactgcacttttc

SEQ ID NO: 301939 - DNA, 20 bp, Artificial Sequence
  Description of Artificial Sequence: Synthetic oligonucleotide
  Target: ATXN1; (+) strand; PAM type: YTN; PAM sequence: TTA
atacaacactgcacttttct

SEQ ID NO: 301940 - DNA, 20 bp, Artificial Sequence
  Description of Artificial Sequence: Synthetic oligonucleotide
  Target: ATXN1; (+) strand; PAM type: YTN; PAM sequence: CTG
cacttttcttaaacaaataa

SEQ ID NO: 301941 - DNA, 20 bp, Artificial Sequence
  Description of Artificial Sequence: Synthetic oligonucleotide
  Target: ATXN1; (+) strand; PAM type: YTN; PAM sequence: CTT
ttcttaaacaaataaacctt

SEQ ID NO: 301942 - DNA, 20 bp, Artificial Sequence
  Description of Artificial Sequence: Synthetic oligonucleotide
  Target: ATXN1; (+) strand; PAM type: YTN; PAM sequence: TTT
tcttaaacaaataaaccttt

SEQ ID NO: 301943 - DNA, 20 bp, Artificial Sequence
  Description of Artificial Sequence: Synthetic oligonucleotide
  Target: ATXN1; (+) strand; PAM type: YTN; PAM sequence: TTT
cttaaacaaataaacctttt

SEQ ID NO: 301944 - DNA, 20 bp, Artificial Sequence
  Description of Artificial Sequence: Synthetic oligonucleotide
  Target: ATXN1; (+) strand; PAM type: YTN; PAM sequence: TTC
ttaaacaaataaaccttttg

SEQ ID NO: 301945 - DNA, 20 bp, Artificial Sequence
  Description of Artificial Sequence: Synthetic oligonucleotide
  Target: ATXN1; (+) strand; PAM type: YTN; PAM sequence: CTT
aaacaaataaaccttttgct

SEQ ID NO: 301946 - DNA, 20 bp, Artificial Sequence
  Description of Artificial Sequence: Synthetic oligonucleotide
  Target: ATXN1; (+) strand; PAM type: YTN; PAM sequence: TTA
aacaaataaaccttttgcta

SEQ ID NO: 301947 - DNA, 20 bp, Artificial Sequence
  Description of Artificial Sequence: Synthetic oligonucleotide
  Target: ATXN1; (+) strand; PAM type: YTN; PAM sequence: CTT
ttgctaaagtggattaaaac

SEQ ID NO: 301948 - DNA, 20 bp, Artificial Sequence
  Description of Artificial Sequence: Synthetic oligonucleotide
  Target: ATXN1; (+) strand; PAM type: YTN; PAM sequence: TTT
tgctaaagtggattaaaaca

SEQ ID NO: 301949 - DNA, 20 bp, Artificial Sequence
  Description of Artificial Sequence: Synthetic oligonucleotide
  Target: ATXN1; (+) strand; PAM type: YTN; PAM sequence: TTT
gctaaagtggattaaaacat

SEQ ID NO: 301950 - DNA, 20 bp, Artificial Sequence
  Description of Artificial Sequence: Synthetic oligonucleotide
  Target: ATXN1; (+) strand; PAM type: YTN; PAM sequence: TTG
ctaaagtggattaaaacatc

SEQ ID NO: 301951 - DNA, 20 bp, Artificial Sequence
  Description of Artificial Sequence: Synthetic oligonucleotide
  Target: ATXN1; (+) strand; PAM type: YTN; PAM sequence: CTA
aagtggattaaaacatctca

SEQ ID NO: 301952 - DNA, 20 bp, Artificial Sequence
  Description of Artificial Sequence: Synthetic oligonucleotide
  Target: ATXN1; (+) strand; PAM type: YTN; PAM sequence: TTA
aaacatctcaacagctacgg

SEQ ID NO: 301953 - DNA, 20 bp, Artificial Sequence
  Description of Artificial Sequence: Synthetic oligonucleotide
  Target: ATXN1; (+) strand; PAM type: YTN; PAM sequence: CTC
aacagctacggcacacatgc

SEQ ID NO: 301954 - DNA, 20 bp, Artificial Sequence
  Description of Artificial Sequence: Synthetic oligonucleotide
  Target: ATXN1; (+) strand; PAM type: YTN; PAM sequence: CTA
cggcacacatgcagtcatta

SEQ ID NO: 301955 - DNA, 20 bp, Artificial Sequence
  Description of Artificial Sequence: Synthetic oligonucleotide
  Target: ATXN1; (+) strand; PAM type: YTN; PAM sequence: TTA
aagactgttcagcatataga

SEQ ID NO: 301956 - DNA, 20 bp, Artificial Sequence
  Description of Artificial Sequence: Synthetic oligonucleotide
  Target: ATXN1; (+) strand; PAM type: YTN; PAM sequence: CTG
ttcagcatatagacagataa

SEQ ID NO: 301957 - DNA, 20 bp, Artificial Sequence
  Description of Artificial Sequence: Synthetic oligonucleotide
  Target: ATXN1; (+) strand; PAM type: YTN; PAM sequence: TTC
agcatatagacagataattt

SEQ ID NO: 301958 - DNA, 20 bp, Artificial Sequence
  Description of Artificial Sequence: Synthetic oligonucleotide
  Target: ATXN1; (+) strand; PAM type: YTN; PAM sequence: TTT
ccacagtgtatggtttaaga

SEQ ID NO: 301959 - DNA, 20 bp, Artificial Sequence
  Description of Artificial Sequence: Synthetic oligonucleotide
  Target: ATXN1; (+) strand; PAM type: YTN; PAM sequence: TTC
cacagtgtatggtttaagaa

SEQ ID NO: 301960 - DNA, 20 bp, Artificial Sequence
  Description of Artificial Sequence: Synthetic oligonucleotide
  Target: ATXN1; (+) strand; PAM type: YTN; PAM sequence: TTT
aagaagttaaacagaaagtt

SEQ ID NO: 301961 - DNA, 20 bp, Artificial Sequence
  Description of Artificial Sequence: Synthetic oligonucleotide
  Target: ATXN1; (+) strand; PAM type: YTN; PAM sequence: TTA
agaagttaaacagaaagtta

SEQ ID NO: 301962 - DNA, 20 bp, Artificial Sequence
  Description of Artificial Sequence: Synthetic oligonucleotide
  Target: ATXN1; (+) strand; PAM type: YTN; PAM sequence: TTA
aacagaaagttaacagagaa

SEQ ID NO: 301963 - DNA, 20 bp, Artificial Sequence
  Description of Artificial Sequence: Synthetic oligonucleotide
  Target: ATXN1; (+) strand; PAM type: YTN; PAM sequence: TTA
acagagaaactgttcttgaa

SEQ ID NO: 301964 - DNA, 20 bp, Artificial Sequence
  Description of Artificial Sequence: Synthetic oligonucleotide
  Target: ATXN1; (+) strand; PAM type: YTN; PAM sequence: CTG
ttcttgaagtatgagaatga

SEQ ID NO: 301965 - DNA, 20 bp, Artificial Sequence
  Description of Artificial Sequence: Synthetic oligonucleotide
  Target: ATXN1; (+) strand; PAM type: YTN; PAM sequence: TTC
ttgaagtatgagaatgatta

SEQ ID NO: 301966 - DNA, 20 bp, Artificial Sequence
  Description of Artificial Sequence: Synthetic oligonucleotide
  Target: ATXN1; (+) strand; PAM type: YTN; PAM sequence: CTT
gaagtatgagaatgattaag

SEQ ID NO: 301967 - DNA, 20 bp, Artificial Sequence
  Description of Artificial Sequence: Synthetic oligonucleotide
  Target: ATXN1; (+) strand; PAM type: YTN; PAM sequence: TTG
aagtatgagaatgattaagt

SEQ ID NO: 301968 - DNA, 20 bp, Artificial Sequence
  Description of Artificial Sequence: Synthetic oligonucleotide
  Target: ATXN1; (+) strand; PAM type: YTN; PAM sequence: TTA
agtggaaatgttaaattttc

SEQ ID NO: 301969 - DNA, 20 bp, Artificial Sequence
  Description of Artificial Sequence: Synthetic oligonucleotide
  Target: ATXN1; (+) strand; PAM type: YTN; PAM sequence: TTA
aattttcaaggcaaagtatt

SEQ ID NO: 301970 - DNA, 20 bp, Artificial Sequence
  Description of Artificial Sequence: Synthetic oligonucleotide
  Target: ATXN1; (+) strand; PAM type: YTN; PAM sequence: TTT
tcaaggcaaagtatttttta

SEQ ID NO: 301971 - DNA, 20 bp, Artificial Sequence
  Description of Artificial Sequence: Synthetic oligonucleotide
  Target: ATXN1; (+) strand; PAM type: YTN; PAM sequence: TTT
caaggcaaagtattttttaa

SEQ ID NO: 301972 - DNA, 20 bp, Artificial Sequence
  Description of Artificial Sequence: Synthetic oligonucleotide
  Target: ATXN1; (+) strand; PAM type: YTN; PAM sequence: TTC
aaggcaaagtattttttaaa

SEQ ID NO: 301973 - DNA, 20 bp, Artificial Sequence
  Description of Artificial Sequence: Synthetic oligonucleotide
  Target: ATXN1; (+) strand; PAM type: YTN; PAM sequence: TTT
tttaaataacctcaaaaatt

SEQ ID NO: 301974 - DNA, 20 bp, Artificial Sequence
  Description of Artificial Sequence: Synthetic oligonucleotide
  Target: ATXN1; (+) strand; PAM type: YTN; PAM sequence: TTT
ttaaataacctcaaaaatta

SEQ ID NO: 301975 - DNA, 20 bp, Artificial Sequence
  Description of Artificial Sequence: Synthetic oligonucleotide
  Target: ATXN1; (+) strand; PAM type: YTN; PAM sequence: TTT
taaataacctcaaaaattaa

SEQ ID NO: 301976 - DNA, 20 bp, Artificial Sequence
  Description of Artificial Sequence: Synthetic oligonucleotide
  Target: ATXN1; (+) strand; PAM type: YTN; PAM sequence: TTT
aaataacctcaaaaattaaa

SEQ ID NO: 301977 - DNA, 20 bp, Artificial Sequence
  Description of Artificial Sequence: Synthetic oligonucleotide
  Target: ATXN1; (+) strand; PAM type: YTN; PAM sequence: TTA
aataacctcaaaaattaaaa

SEQ ID NO: 301978 - DNA, 20 bp, Artificial Sequence
  Description of Artificial Sequence: Synthetic oligonucleotide
  Target: ATXN1; (+) strand; PAM type: YTN; PAM sequence: CTC
aaaaattaaaaaaaaaaaaa

SEQ ID NO: 301979 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaaaaaaaaaag

SEQ ID NO: 301980 - DNA, 20 bp, Artificial Sequence
  Description of Artificial Sequence: Synthetic oligonucleotide
  Target: ATXN1; (+) strand; PAM type: YTN; PAM sequence: CTT
cactgaagctaaaaagacat

SEQ ID NO: 301981 - DNA, 20 bp, Artificial Sequence
  Description of Artificial Sequence: Synthetic oligonucleotide
  Target: ATXN1; (+) strand; PAM type: YTN; PAM sequence: TTC
actgaagctaaaaagacatg

SEQ ID NO: 301982 - DNA, 20 bp, Artificial Sequence
  Description of Artificial Sequence: Synthetic oligonucleotide
  Target: ATXN1; (+) strand; PAM type: YTN; PAM sequence: CTG
aagctaaaaagacatgacca

SEQ ID NO: 301983 - DNA, 20 bp, Artificial Sequence
  Description of Artificial Sequence: Synthetic oligonucleotide
  Target: ATXN1; (+) strand; PAM type: YTN; PAM sequence: CTA
aaaagacatgaccaatgaag

SEQ ID NO: 301984 - DNA, 20 bp, Artificial Sequence
  Description of Artificial Sequence: Synthetic oligonucleotide
  Target: ATXN1; (+) strand; PAM type: YTN; PAM sequence: TTA
aattaggagtctggagtctg

SEQ ID NO: 301985 - DNA, 20 bp, Artificial Sequence
  Description of Artificial Sequence: Synthetic oligonucleotide
  Target: ATXN1; (+) strand; PAM type: YTN; PAM sequence: TTA
ggagtctggagtctggtttt

SEQ ID NO: 301986 - DNA, 20 bp, Artificial Sequence
  Description of Artificial Sequence: Synthetic oligonucleotide
  Target: ATXN1; (+) strand; PAM type: YTN; PAM sequence: CTG
gagtctggttttcagcctca

SEQ ID NO: 301987 - DNA, 20 bp, Artificial Sequence
  Description of Artificial Sequence: Synthetic oligonucleotide
  Target: ATXN1; (+) strand; PAM type: YTN; PAM sequence: CTG
gttttcagcctcagccatca

SEQ ID NO: 301988 - DNA, 20 bp, Artificial Sequence
  Description of Artificial Sequence: Synthetic oligonucleotide
  Target: ATXN1; (+) strand; PAM type: YTN; PAM sequence: TTT
tcagcctcagccatcaaaca

SEQ ID NO: 301989 - DNA, 20 bp, Artificial Sequence
  Description of Artificial Sequence: Synthetic oligonucleotide
  Target: ATXN1; (+) strand; PAM type: YTN; PAM sequence: TTT
cagcctcagccatcaaacaa

SEQ ID NO: 301990 - DNA, 20 bp, Artificial Sequence
  Description of Artificial Sequence: Synthetic oligonucleotide
  Target: ATXN1; (+) strand; PAM type: YTN; PAM sequence: TTC
agcctcagccatcaaacaaa

SEQ ID NO: 301991 - DNA, 20 bp, Artificial Sequence
  Description of Artificial Sequence: Synthetic oligonucleotide
  Target: ATXN1; (+) strand; PAM type: YTN; PAM sequence: CTC
agccatcaaacaaacaggct

SEQ ID NO: 301992 - DNA, 20 bp, Artificial Sequence
  Description of Artificial Sequence: Synthetic oligonucleotide
  Target: ATXN1; (+) strand; PAM type: YTN; PAM sequence: CTG
tgtgttgtaggagtggtcat

SEQ ID NO: 301993 - DNA, 20 bp, Artificial Sequence
  Description of Artificial Sequence: Synthetic oligonucleotide
  Target: ATXN1; (+) strand; PAM type: YTN; PAM sequence: TTG
taggagtggtcatttaaccg

SEQ ID NO: 301994 - DNA, 20 bp, Artificial Sequence
  Description of Artificial Sequence: Synthetic oligonucleotide
  Target: ATXN1; (+) strand; PAM type: YTN; PAM sequence: TTT
aaccgcactaagcctcaaat

SEQ ID NO: 301995 - DNA, 20 bp, Artificial Sequence
  Description of Artificial Sequence: Synthetic oligonucleotide
  Target: ATXN1; (+) strand; PAM type: YTN; PAM sequence: TTA
accgcactaagcctcaaatg

SEQ ID NO: 301996 - DNA, 20 bp, Artificial Sequence
  Description of Artificial Sequence: Synthetic oligonucleotide
  Target: ATXN1; (+) strand; PAM type: YTN; PAM sequence: CTA
agcctcaaatgtttcctctg

SEQ ID NO: 301997 - DNA, 20 bp, Artificial Sequence
  Description of Artificial Sequence: Synthetic oligonucleotide
  Target: ATXN1; (+) strand; PAM type: YTN; PAM sequence: CTC
aaatgtttcctctgtaaaat

SEQ ID NO: 301998 - DNA, 20 bp, Artificial Sequence
  Description of Artificial Sequence: Synthetic oligonucleotide
  Target: ATXN1; (+) strand; PAM type: YTN; PAM sequence: TTT
cctctgtaaaattagaacat

SEQ ID NO: 301999 - DNA, 20 bp, Artificial Sequence
  Description of Artificial Sequence: Synthetic oligonucleotide
  Target: ATXN1; (+) strand; PAM type: YTN; PAM sequence: TTC
ctctgtaaaattagaacatt

SEQ ID NO: 302000 - DNA, 20 bp, Artificial Sequence
  Description of Artificial Sequence: Synthetic oligonucleotide
  Target: ATXN1; (+) strand; PAM type: YTN; PAM sequence: CTC
tgtaaaattagaacattagg

SEQ ID NO: 302001 - DNA, 20 bp, Artificial Sequence
  Description of Artificial Sequence: Synthetic oligonucleotide
  Target: ATXN1; (+) strand; PAM type: YTN; PAM sequence: CTG
taaaattagaacattaggtt

SEQ ID NO: 302002 - DNA, 20 bp, Artificial Sequence
  Description of Artificial Sequence: Synthetic oligonucleotide
  Target: ATXN1; (+) strand; PAM type: YTN; PAM sequence: TTA
gaacattaggttcaattaaa

SEQ ID NO: 302003 - DNA, 20 bp, Artificial Sequence
  Description of Artificial Sequence: Synthetic oligonucleotide
  Target: ATXN1; (+) strand; PAM type: YTN; PAM sequence: TTA
ggttcaattaaagccattta

SEQ ID NO: 302004 - DNA, 20 bp, Artificial Sequence
  Description of Artificial Sequence: Synthetic oligonucleotide
  Target: ATXN1; (+) strand; PAM type: YTN; PAM sequence: TTC
aattaaagccatttaagctt

SEQ ID NO: 302005 - DNA, 20 bp, Artificial Sequence
  Description of Artificial Sequence: Synthetic oligonucleotide
  Target: ATXN1; (+) strand; PAM type: YTN; PAM sequence: TTA
aagccatttaagctttaaaa

SEQ ID NO: 302006 - DNA, 20 bp, Artificial Sequence
  Description of Artificial Sequence: Synthetic oligonucleotide
  Target: ATXN1; (+) strand; PAM type: YTN; PAM sequence: TTT
aagctttaaaattctacgat

SEQ ID NO: 302007 - DNA, 20 bp, Artificial Sequence
  Description of Artificial Sequence: Synthetic oligonucleotide
  Target: ATXN1; (+) strand; PAM type: YTN; PAM sequence: TTA
agctttaaaattctacgatt

SEQ ID NO: 302008 - DNA, 20 bp, Artificial Sequence
  Description of Artificial Sequence: Synthetic oligonucleotide
  Target: ATXN1; (+) strand; PAM type: YTN; PAM sequence: CTT
taaaattctacgattgtccg

SEQ ID NO: 302009 - DNA, 20 bp, Artificial Sequence
  Description of Artificial Sequence: Synthetic oligonucleotide
  Target: ATXN1; (+) strand; PAM type: YTN; PAM sequence: TTT
aaaattctacgattgtccgt

SEQ ID NO: 302010 - DNA, 20 bp, Artificial Sequence
  Description of Artificial Sequence: Synthetic oligonucleotide
  Target: ATXN1; (+) strand; PAM type: YTN; PAM sequence: TTA
aaattctacgattgtccgtc

SEQ ID NO: 302011 - DNA, 20 bp, Artificial Sequence
  Description of Artificial Sequence: Synthetic oligonucleotide
  Target: ATXN1; (+) strand; PAM type: YTN; PAM sequence: TTC
tacgattgtccgtccaattc

SEQ ID NO: 302012 - DNA, 20 bp, Artificial Sequence
  Description of Artificial Sequence: Synthetic oligonucleotide
  Target: ATXN1; (+) strand; PAM type: YTN; PAM sequence: CTA
cgattgtccgtccaattcaa

SEQ ID NO: 302013 - DNA, 20 bp, Artificial Sequence
  Description of Artificial Sequence: Synthetic oligonucleotide
  Target: ATXN1; (+) strand; PAM type: YTN; PAM sequence: TTG
tccgtccaattcaataaaat

SEQ ID NO: 302014 - DNA, 20 bp, Artificial Sequence
  Description of Artificial Sequence: Synthetic oligonucleotide
  Target: ATXN1; (+) strand; PAM type: YTN; PAM sequence: TTC
aataaaataaactgtattta

SEQ ID NO: 302015 - DNA, 20 bp, Artificial Sequence
  Description of Artificial Sequence: Synthetic oligonucleotide
  Target: ATXN1; (+) strand; PAM type: YTN; PAM sequence: CTG
tatttaataatacctgcttt

SEQ ID NO: 302016 - DNA, 20 bp, Artificial Sequence
  Description of Artificial Sequence: Synthetic oligonucleotide
  Target: ATXN1; (+) strand; PAM type: YTN; PAM sequence: TTT
aataatacctgctttttcaa

SEQ ID NO: 302017 - DNA, 20 bp, Artificial Sequence
  Description of Artificial Sequence: Synthetic oligonucleotide
  Target: ATXN1; (+) strand; PAM type: YTN; PAM sequence: TTA
ataatacctgctttttcaac

SEQ ID NO: 302018 - DNA, 20 bp, Artificial Sequence
  Description of Artificial Sequence: Synthetic oligonucleotide
  Target: ATXN1; (+) strand; PAM type: YTN; PAM sequence: CTG
ctttttcaactaagctaatt

SEQ ID NO: 302019 - DNA, 20 bp, Artificial Sequence
  Description of Artificial Sequence: Synthetic oligonucleotide
  Target: ATXN1; (+) strand; PAM type: YTN; PAM sequence: CTT
tttcaactaagctaattttt

SEQ ID NO: 302020 - DNA, 20 bp, Artificial Sequence
  Description of Artificial Sequence: Synthetic oligonucleotide
  Target: ATXN1; (+) strand; PAM type: YTN; PAM sequence: TTT
ttcaactaagctaatttttt

SEQ ID NO: 302021 - DNA, 20 bp, Artificial Sequence
  Description of Artificial Sequence: Synthetic oligonucleotide
  Target: ATXN1; (+) strand; PAM type: YTN; PAM sequence: TTT
tcaactaagctaatttttta

SEQ ID NO: 302022 - DNA, 20 bp, Artificial Sequence
  Description of Artificial Sequence: Synthetic oligonucleotide
  Target: ATXN1; (+) strand; PAM type: YTN; PAM sequence: TTT
caactaagctaattttttaa

SEQ ID NO: 302023 - DNA, 20 bp, Artificial Sequence
  Description of Artificial Sequence: Synthetic oligonucleotide
  Target: ATXN1; (+) strand; PAM type: YTN; PAM sequence: TTC
aactaagctaattttttaaa

SEQ ID NO: 302024 - DNA, 20 bp, Artificial Sequence
  Description of Artificial Sequence: Synthetic oligonucleotide
  Target: ATXN1; (+) strand; PAM type: YTN; PAM sequence: CTA
agctaattttttaaaaggca

SEQ ID NO: 302025 - DNA, 20 bp, Artificial Sequence
  Description of Artificial Sequence: Synthetic oligonucleotide
  Target: ATXN1; (+) strand; PAM type: YTN; PAM sequence: CTA
attttttaaaaggcagaaaa

SEQ ID NO: 302026 - DNA, 20 bp, Artificial Sequence
  Description of Artificial Sequence: Synthetic oligonucleotide
  Target: ATXN1; (+) strand; PAM type: YTN; PAM sequence: TTT
tttaaaaggcagaaaatcta

SEQ ID NO: 302027 - DNA, 20 bp, Artificial Sequence
  Description of Artificial Sequence: Synthetic oligonucleotide
  Target: ATXN1; (+) strand; PAM type: YTN; PAM sequence: TTT
ttaaaaggcagaaaatctaa

SEQ ID NO: 302028 - DNA, 20 bp, Artificial Sequence
  Description of Artificial Sequence: Synthetic oligonucleotide
  Target: ATXN1; (+) strand; PAM type: YTN; PAM sequence: TTT
taaaaggcagaaaatctaac

SEQ ID NO: 302029 - DNA, 20 bp, Artificial Sequence
  Description of Artificial Sequence: Synthetic oligonucleotide
  Target: ATXN1; (+) strand; PAM type: YTN; PAM sequence: TTT
aaaaggcagaaaatctaacc

SEQ ID NO: 302030 - DNA, 20 bp, Artificial Sequence
  Description of Artificial Sequence: Synthetic oligonucleotide
  Target: ATXN1; (+) strand; PAM type: YTN; PAM sequence: TTA
aaaggcagaaaatctaacca

SEQ ID NO: 302031 - DNA, 20 bp, Artificial Sequence
  Description of Artificial Sequence: Synthetic oligonucleotide
  Target: ATXN1; (+) strand; PAM type: YTN; PAM sequence: CTA
accagaaaagaataaaaaat

SEQ ID NO: 302032 - DNA, 20 bp, Artificial Sequence
  Description of Artificial Sequence: Synthetic oligonucleotide
  Target: ATXN1; (+) strand; PAM type: YTN; PAM sequence: TTT
aacttgtacaacataaactt

SEQ ID NO: 302033 - DNA, 20 bp, Artificial Sequence
  Description of Artificial Sequence: Synthetic oligonucleotide
  Target: ATXN1; (+) strand; PAM type: YTN; PAM sequence: TTA
acttgtacaacataaacttt

SEQ ID NO: 302034 - DNA, 20 bp, Artificial Sequence
  Description of Artificial Sequence: Synthetic oligonucleotide
  Target: ATXN1; (+) strand; PAM type: YTN; PAM sequence: CTT
gtacaacataaactttgtcc

SEQ ID NO: 302035 - DNA, 20 bp, Artificial Sequence
  Description of Artificial Sequence: Synthetic oligonucleotide
  Target: ATXN1; (+) strand; PAM type: YTN; PAM sequence: TTG
tacaacataaactttgtcca

SEQ ID NO: 302036 - DNA, 20 bp, Artificial Sequence
  Description of Artificial Sequence: Synthetic oligonucleotide
  Target: ATXN1; (+) strand; PAM type: YTN; PAM sequence: CTT
tgtccagaaatcagtatctg

SEQ ID NO: 302037 - DNA, 20 bp, Artificial Sequence
  Description of Artificial Sequence: Synthetic oligonucleotide
  Target: ATXN1; (+) strand; PAM type: YTN; PAM sequence: TTT
gtccagaaatcagtatctgc

SEQ ID NO: 302038 - DNA, 20 bp, Artificial Sequence
  Description of Artificial Sequence: Synthetic oligonucleotide
  Target: ATXN1; (+) strand; PAM type: YTN; PAM sequence: TTG
tccagaaatcagtatctgct

SEQ ID NO: 302039 - DNA, 20 bp, Artificial Sequence
  Description of Artificial Sequence: Synthetic oligonucleotide
  Target: ATXN1; (+) strand; PAM type: YTN; PAM sequence: CTG
ctcttccaaagaaaaatagc

SEQ ID NO: 302040 - DNA, 20 bp, Artificial Sequence
  Description of Artificial Sequence: Synthetic oligonucleotide
  Target: ATXN1; (+) strand; PAM type: YTN; PAM sequence: CTC
ttccaaagaaaaatagcctt

SEQ ID NO: 302041 - DNA, 20 bp, Artificial Sequence
  Description of Artificial Sequence: Synthetic oligonucleotide
  Target: ATXN1; (+) strand; PAM type: YTN; PAM sequence: CTT
ccaaagaaaaatagcctttt

SEQ ID NO: 302042 - DNA, 20 bp, Artificial Sequence
  Description of Artificial Sequence: Synthetic oligonucleotide
  Target: ATXN1; (+) strand; PAM type: YTN; PAM sequence: TTC
caaagaaaaatagccttttg

SEQ ID NO: 302043 - DNA, 20 bp, Artificial Sequence
  Description of Artificial Sequence: Synthetic oligonucleotide
  Target: ATXN1; (+) strand; PAM type: YTN; PAM sequence: CTT
ttgttttctattgttcagtg

SEQ ID NO: 302044 - DNA, 20 bp, Artificial Sequence
  Description of Artificial Sequence: Synthetic oligonucleotide
  Target: ATXN1; (+) strand; PAM type: YTN; PAM sequence: TTT
tgttttctattgttcagtgt

SEQ ID NO: 302045 - DNA, 20 bp, Artificial Sequence
  Description of Artificial Sequence: Synthetic oligonucleotide
  Target: ATXN1; (+) strand; PAM type: YTN; PAM sequence: TTT
gttttctattgttcagtgta

SEQ ID NO: 302046 - DNA, 20 bp, Artificial Sequence
  Description of Artificial Sequence: Synthetic oligonucleotide
  Target: ATXN1; (+) strand; PAM type: YTN; PAM sequence: TTG
ttttctattgttcagtgtac

SEQ ID NO: 302047 - DNA, 20 bp, Artificial Sequence
  Description of Artificial Sequence: Synthetic oligonucleotide
  Target: ATXN1; (+) strand; PAM type: YTN; PAM sequence: TTT
tctattgttcagtgtacagc

SEQ ID NO: 302048 - DNA, 20 bp, Artificial Sequence
  Description of Artificial Sequence: Synthetic oligonucleotide
  Target: ATXN1; (+) strand; PAM type: YTN; PAM sequence: TTT
ctattgttcagtgtacagct

SEQ ID NO: 302049 - DNA, 20 bp, Artificial Sequence
  Description of Artificial Sequence: Synthetic oligonucleotide
  Target: ATXN1; (+) strand; PAM type: YTN; PAM sequence: TTC
tattgttcagtgtacagctt

SEQ ID NO: 302050 - DNA, 20 bp, Artificial Sequence
  Description of Artificial Sequence: Synthetic oligonucleotide
  Target: ATXN1; (+) strand; PAM type: YTN; PAM sequence: CTA
ttgttcagtgtacagcttac

SEQ ID NO: 302051 - DNA, 20 bp, Artificial Sequence
  Description of Artificial Sequence: Synthetic oligonucleotide
  Target: ATXN1; (+) strand; PAM type: YTN; PAM sequence: TTG
ttcagtgtacagcttaccac

SEQ ID NO: 302052 - DNA, 20 bp, Artificial Sequence
  Description of Artificial Sequence: Synthetic oligonucleotide
  Target: ATXN1; (+) strand; PAM type: YTN; PAM sequence: TTC
agtgtacagcttaccactaa

SEQ ID NO: 302053 - DNA, 20 bp, Artificial Sequence
  Description of Artificial Sequence: Synthetic oligonucleotide
  Target: ATXN1; (+) strand; PAM type: YTN; PAM sequence: CTT
accactaagcaaggaataaa

SEQ ID NO: 302054 - DNA, 20 bp, Artificial Sequence
  Description of Artificial Sequence: Synthetic oligonucleotide
  Target: ATXN1; (+) strand; PAM type: YTN; PAM sequence: TTA
ccactaagcaaggaataaat

SEQ ID NO: 302055 - DNA, 20 bp, Artificial Sequence
  Description of Artificial Sequence: Synthetic oligonucleotide
  Target: ATXN1; (+) strand; PAM type: YTN; PAM sequence: CTA
agcaaggaataaatgtgggg

SEQ ID NO: 302056 - DNA, 20 bp, Artificial Sequence
  Description of Artificial Sequence: Synthetic oligonucleotide
  Target: ATXN1; (+) strand; PAM type: YTN; PAM sequence: CTA
cagttcatctgtatgtgcca

SEQ ID NO: 302057 - DNA, 20 bp, Artificial Sequence
  Description of Artificial Sequence: Synthetic oligonucleotide
  Target: ATXN1; (+) strand; PAM type: YTN; PAM sequence: TTC
atctgtatgtgccagcatgt

SEQ ID NO: 302058 - DNA, 20 bp, Artificial Sequence
  Description of Artificial Sequence: Synthetic oligonucleotide
  Target: ATXN1; (+) strand; PAM type: YTN; PAM sequence: CTG
tatgtgccagcatgttactt

SEQ ID NO: 302059 - DNA, 20 bp, Artificial Sequence
  Description of Artificial Sequence: Synthetic oligonucleotide
  Target: ATXN1; (+) strand; PAM type: YTN; PAM sequence: TTA
ctttcaagggttcagtagct

SEQ ID NO: 302060 - DNA, 20 bp, Artificial Sequence
  Description of Artificial Sequence: Synthetic oligonucleotide
  Target: ATXN1; (+) strand; PAM type: YTN; PAM sequence: CTT
tcaagggttcagtagctcca

SEQ ID NO: 302061 - DNA, 20 bp, Artificial Sequence
  Description of Artificial Sequence: Synthetic oligonucleotide
  Target: ATXN1; (+) strand; PAM type: YTN; PAM sequence: TTT
caagggttcagtagctccac

SEQ ID NO: 302062 - DNA, 20 bp, Artificial Sequence
  Description of Artificial Sequence: Synthetic oligonucleotide
  Target: ATXN1; (+) strand; PAM type: YTN; PAM sequence: TTC
aagggttcagtagctccacg

SEQ ID NO: 302063 - DNA, 20 bp, Artificial Sequence
  Description of Artificial Sequence: Synthetic oligonucleotide
  Target: ATXN1; (+) strand; PAM type: YTN; PAM sequence: TTC
agtagctccacggcagaaag

SEQ ID NO: 302064 - DNA, 20 bp, Artificial Sequence
  Description of Artificial Sequence: Synthetic oligonucleotide
  Target: ATXN1; (+) strand; PAM type: YTN; PAM sequence: CTC
cacggcagaaagaaacttct

SEQ ID NO: 302065 - DNA, 20 bp, Artificial Sequence
  Description of Artificial Sequence: Synthetic oligonucleotide
  Target: ATXN1; (+) strand; PAM type: YTN; PAM sequence: CTT
ctctattactcactattaaa

SEQ ID NO: 302066 - DNA, 20 bp, Artificial Sequence
  Description of Artificial Sequence: Synthetic oligonucleotide
  Target: ATXN1; (+) strand; PAM type: YTN; PAM sequence: TTC
tctattactcactattaaac

SEQ ID NO: 302067 - DNA, 20 bp, Artificial Sequence
  Description of Artificial Sequence: Synthetic oligonucleotide
  Target: ATXN1; (+) strand; PAM type: YTN; PAM sequence: CTC
tattactcactattaaactg

SEQ ID NO: 302068 - DNA, 20 bp, Artificial Sequence
  Description of Artificial Sequence: Synthetic oligonucleotide
  Target: ATXN1; (+) strand; PAM type: YTN; PAM sequence: CTA
ttactcactattaaactgca

SEQ ID NO: 302069 - DNA, 20 bp, Artificial Sequence
  Description of Artificial Sequence: Synthetic oligonucleotide
  Target: ATXN1; (+) strand; PAM type: YTN; PAM sequence: TTA
ctcactattaaactgcattt

SEQ ID NO: 302070 - DNA, 20 bp, Artificial Sequence
  Description of Artificial Sequence: Synthetic oligonucleotide
  Target: ATXN1; (+) strand; PAM type: YTN; PAM sequence: CTC
actattaaactgcatttcaa

SEQ ID NO: 302071 - DNA, 20 bp, Artificial Sequence
  Description of Artificial Sequence: Synthetic oligonucleotide
  Target: ATXN1; (+) strand; PAM type: YTN; PAM sequence: CTA
ttaaactgcatttcaaaacc

SEQ ID NO: 302072 - DNA, 20 bp, Artificial Sequence
  Description of Artificial Sequence: Synthetic oligonucleotide
  Target: ATXN1; (+) strand; PAM type: YTN; PAM sequence: TTA
aactgcatttcaaaacctac

SEQ ID NO: 302073 - DNA, 20 bp, Artificial Sequence
  Description of Artificial Sequence: Synthetic oligonucleotide
  Target: ATXN1; (+) strand; PAM type: YTN; PAM sequence: CTG
catttcaaaacctacaaaaa

SEQ ID NO: 302074 - DNA, 20 bp, Artificial Sequence
  Description of Artificial Sequence: Synthetic oligonucleotide
  Target: ATXN1; (+) strand; PAM type: YTN; PAM sequence: TTT
caaaacctacaaaaacagct

SEQ ID NO: 302075 - DNA, 20 bp, Artificial Sequence
  Description of Artificial Sequence: Synthetic oligonucleotide
  Target: ATXN1; (+) strand; PAM type: YTN; PAM sequence: TTC
aaaacctacaaaaacagctc

SEQ ID NO: 302076 - DNA, 20 bp, Artificial Sequence
  Description of Artificial Sequence: Synthetic oligonucleotide
  Target: ATXN1; (+) strand; PAM type: YTN; PAM sequence: CTA
caaaaacagctccaaaatta

SEQ ID NO: 302077 - DNA, 20 bp, Artificial Sequence
  Description of Artificial Sequence: Synthetic oligonucleotide
  Target: ATXN1; (+) strand; PAM type: YTN; PAM sequence: CTC
caaaattaagccagcaaaat

SEQ ID NO: 302078 - DNA, 20 bp, Artificial Sequence
  Description of Artificial Sequence: Synthetic oligonucleotide
  Target: ATXN1; (+) strand; PAM type: YTN; PAM sequence: TTA
agccagcaaaatgttgctgt

SEQ ID NO: 302079 - DNA, 20 bp, Artificial Sequence
  Description of Artificial Sequence: Synthetic oligonucleotide
  Target: ATXN1; (+) strand; PAM type: YTN; PAM sequence: TTG
ctgtcatccatctgaacctg

SEQ ID NO: 302080 - DNA, 20 bp, Artificial Sequence
  Description of Artificial Sequence: Synthetic oligonucleotide
  Target: ATXN1; (+) strand; PAM type: YTN; PAM sequence: CTG
tcatccatctgaacctgtta

SEQ ID NO: 302081 - DNA, 20 bp, Artificial Sequence
  Description of Artificial Sequence: Synthetic oligonucleotide
  Target: ATXN1; (+) strand; PAM type: YTN; PAM sequence: CTG
aacctgttagaaatctcaag

SEQ ID NO: 302082 - DNA, 20 bp, Artificial Sequence
  Description of Artificial Sequence: Synthetic oligonucleotide
  Target: ATXN1; (+) strand; PAM type: YTN; PAM sequence: CTG
ttagaaatctcaagctcgtc

SEQ ID NO: 302083 - DNA, 20 bp, Artificial Sequence
  Description of Artificial Sequence: Synthetic oligonucleotide
  Target: ATXN1; (+) strand; PAM type: YTN; PAM sequence: TTA
gaaatctcaagctcgtcata

SEQ ID NO: 302084 - DNA, 20 bp, Artificial Sequence
  Description of Artificial Sequence: Synthetic oligonucleotide
  Target: ATXN1; (+) strand; PAM type: YTN; PAM sequence: CTC
aagctcgtcatagaatcttt

SEQ ID NO: 302085 - DNA, 20 bp, Artificial Sequence
  Description of Artificial Sequence: Synthetic oligonucleotide
  Target: ATXN1; (+) strand; PAM type: YTN; PAM sequence: CTC
gtcatagaatctttgacctc

SEQ ID NO: 302086 - DNA, 20 bp, Artificial Sequence
  Description of Artificial Sequence: Synthetic oligonucleotide
  Target: ATXN1; (+) strand; PAM type: YTN; PAM sequence: CTT
tgacctcaccattcaatgtt

SEQ ID NO: 302087 - DNA, 20 bp, Artificial Sequence
  Description of Artificial Sequence: Synthetic oligonucleotide
  Target: ATXN1; (+) strand; PAM type: YTN; PAM sequence: TTT
gacctcaccattcaatgttt

SEQ ID NO: 302088 - DNA, 20 bp, Artificial Sequence
  Description of Artificial Sequence: Synthetic oligonucleotide
  Target: ATXN1; (+) strand; PAM type: YTN; PAM sequence: TTG
acctcaccattcaatgtttt

SEQ ID NO: 302089 - DNA, 20 bp, Artificial Sequence
  Description of Artificial Sequence: Synthetic oligonucleotide
  Target: ATXN1; (+) strand; PAM type: YTN; PAM sequence: CTC
accattcaatgttttacaaa

SEQ ID NO: 302090 - DNA, 20 bp, Artificial Sequence
  Description of Artificial Sequence: Synthetic oligonucleotide
  Target: ATXN1; (+) strand; PAM type: YTN; PAM sequence: TTC
aatgttttacaaattgagta

SEQ ID NO: 302091 - DNA, 20 bp, Artificial Sequence
  Description of Artificial Sequence: Synthetic oligonucleotide
  Target: ATXN1; (+) strand; PAM type: YTN; PAM sequence: TTT
tacaaattgagtaactatgt

SEQ ID NO: 302092 - DNA, 20 bp, Artificial Sequence
  Description of Artificial Sequence: Synthetic oligonucleotide
  Target: ATXN1; (+) strand; PAM type: YTN; PAM sequence: TTT
acaaattgagtaactatgtc

SEQ ID NO: 302093 - DNA, 20 bp, Artificial Sequence
  Description of Artificial Sequence: Synthetic oligonucleotide
  Target: ATXN1; (+) strand; PAM type: YTN; PAM sequence: TTA
caaattgagtaactatgtcc

SEQ ID NO: 302094 - DNA, 20 bp, Artificial Sequence
  Description of Artificial Sequence: Synthetic oligonucleotide
  Target: ATXN1; (+) strand; PAM type: YTN; PAM sequence: TTG
agtaactatgtccctgtcat

SEQ ID NO: 302095 - DNA, 20 bp, Artificial Sequence
  Description of Artificial Sequence: Synthetic oligonucleotide
  Target: ATXN1; (+) strand; PAM type: YTN; PAM sequence: CTA
tgtccctgtcatttactact

SEQ ID NO: 302096 - DNA, 20 bp, Artificial Sequence
  Description of Artificial Sequence: Synthetic oligonucleotide
  Target: ATXN1; (+) strand; PAM type: YTN; PAM sequence: CTG
tcatttactactaaaatgac

SEQ ID NO: 302097 - DNA, 20 bp, Artificial Sequence
  Description of Artificial Sequence: Synthetic oligonucleotide
  Target: ATXN1; (+) strand; PAM type: YTN; PAM sequence: TTT
actactaaaatgacaaaaat

SEQ ID NO: 302098 - DNA, 20 bp, Artificial Sequence
  Description of Artificial Sequence: Synthetic oligonucleotide
  Target: ATXN1; (+) strand; PAM type: YTN; PAM sequence: TTA
ctactaaaatgacaaaaata

SEQ ID NO: 302099 - DNA, 20 bp, Artificial Sequence
  Description of Artificial Sequence: Synthetic oligonucleotide
  Target: ATXN1; (+) strand; PAM type: YTN; PAM sequence: CTA
ctaaaatgacaaaaataaaa

SEQ ID NO: 302100 - DNA, 20 bp, Artificial Sequence
  Description of Artificial Sequence: Synthetic oligonucleotide
  Target: ATXN1; (+) strand; PAM type: YTN; PAM sequence: CTA
aaatgacaaaaataaaaata

SEQ ID NO: 302101 - DNA, 20 bp, Artificial Sequence
  Description of Artificial Sequence: Synthetic oligonucleotide
  Target: ATXN1; (+) strand; PAM type: YTN; PAM sequence: CTG
aaggttaggagtaggtgagg

SEQ ID NO: 302102 - DNA, 20 bp, Artificial Sequence
  Description of Artificial Sequence: Synthetic oligonucleotide
  Target: ATXN1; (+) strand; PAM type: YTN; PAM sequence: TTA
ggagtaggtgaggatgggaa

SEQ ID NO: 302103 - DNA, 20 bp, Artificial Sequence
  Description of Artificial Sequence: Synthetic oligonucleotide
  Target: ATXN1; (+) strand; PAM type: YTN; PAM sequence: CTG
aattcagagctagattccaa

SEQ ID NO: 302104 - DNA, 20 bp, Artificial Sequence
  Description of Artificial Sequence: Synthetic oligonucleotide
  Target: ATXN1; (+) strand; PAM type: YTN; PAM sequence: TTC
agagctagattccaagtggg

SEQ ID NO: 302105 - DNA, 20 bp, Artificial Sequence
  Description of Artificial Sequence: Synthetic oligonucleotide
  Target: ATXN1; (+) strand; PAM type: YTN; PAM sequence: CTA
gattccaagtgggtttcagg

SEQ ID NO: 302106 - DNA, 20 bp, Artificial Sequence
  Description of Artificial Sequence: Synthetic oligonucleotide
  Target: ATXN1; (+) strand; PAM type: YTN; PAM sequence: TTC
caagtgggtttcagggagga

SEQ ID NO: 302107 - DNA, 20 bp, Artificial Sequence
  Description of Artificial Sequence: Synthetic oligonucleotide
  Target: ATXN1; (+) strand; PAM type: YTN; PAM sequence: TTT
cagggaggactgaagtcaga

SEQ ID NO: 302108 - DNA, 20 bp, Artificial Sequence
  Description of Artificial Sequence: Synthetic oligonucleotide
  Target: ATXN1; (+) strand; PAM type: YTN; PAM sequence: TTC
agggaggactgaagtcagag

SEQ ID NO: 302109 - DNA, 20 bp, Artificial Sequence
  Description of Artificial Sequence: Synthetic oligonucleotide
  Target: ATXN1; (+) strand; PAM type: YTN; PAM sequence: CTG
aagtcagagaactgcaaatg

SEQ ID NO: 302110 - DNA, 20 bp, Artificial Sequence
  Description of Artificial Sequence: Synthetic oligonucleotide
  Target: ATXN1; (+) strand; PAM type: YTN; PAM sequence: CTG
caaatgttgtttcaccatct

SEQ ID NO: 302111 - DNA, 20 bp, Artificial Sequence
  Description of Artificial Sequence: Synthetic oligonucleotide
  Target: ATXN1; (+) strand; PAM type: YTN; PAM sequence: TTG
tttcaccatctgtttattca

SEQ ID NO: 302112 - DNA, 20 bp, Artificial Sequence
  Description of Artificial Sequence: Synthetic oligonucleotide
  Target: ATXN1; (+) strand; PAM type: YTN; PAM sequence: TTT
caccatctgtttattcacag

SEQ ID NO: 302113 - DNA, 20 bp, Artificial Sequence
  Description of Artificial Sequence: Synthetic oligonucleotide
  Target: ATXN1; (+) strand; PAM type: YTN; PAM sequence: TTC
accatctgtttattcacagc

SEQ ID NO: 302114 - DNA, 20 bp, Artificial Sequence
  Description of Artificial Sequence: Synthetic oligonucleotide
  Target: ATXN1; (+) strand; PAM type: YTN; PAM sequence: CTG
tttattcacagctttacctt

SEQ ID NO: 302115 - DNA, 20 bp, Artificial Sequence
  Description of Artificial Sequence: Synthetic oligonucleotide
  Target: ATXN1; (+) strand; PAM type: YTN; PAM sequence: TTT
attcacagctttacctttga

SEQ ID NO: 302116 - DNA, 20 bp, Artificial Sequence
  Description of Artificial Sequence: Synthetic oligonucleotide
  Target: ATXN1; (+) strand; PAM type: YTN; PAM sequence: TTA
ttcacagctttacctttgac

SEQ ID NO: 302117 - DNA, 20 bp, Artificial Sequence
  Description of Artificial Sequence: Synthetic oligonucleotide
  Target: ATXN1; (+) strand; PAM type: YTN; PAM sequence: TTC
acagctttacctttgactca

SEQ ID NO: 302118 - DNA, 20 bp, Artificial Sequence
  Description of Artificial Sequence: Synthetic oligonucleotide
  Target: ATXN1; (+) strand; PAM type: YTN; PAM sequence: CTT
tacctttgactcatcagagt

SEQ ID NO: 302119 - DNA, 20 bp, Artificial Sequence
  Description of Artificial Sequence: Synthetic oligonucleotide
  Target: ATXN1; (+) strand; PAM type: YTN; PAM sequence: TTT
acctttgactcatcagagtg

SEQ ID NO: 302120 - DNA, 20 bp, Artificial Sequence
  Description of Artificial Sequence: Synthetic oligonucleotide
  Target: ATXN1; (+) strand; PAM type: YTN; PAM sequence: TTA
cctttgactcatcagagtga

SEQ ID NO: 302121 - DNA, 20 bp, Artificial Sequence
  Description of Artificial Sequence: Synthetic oligonucleotide
  Target: ATXN1; (+) strand; PAM type: YTN; PAM sequence: CTT
tgactcatcagagtgaggtc

SEQ ID NO: 302122 - DNA, 20 bp, Artificial Sequence
  Description of Artificial Sequence: Synthetic oligonucleotide
  Target: ATXN1; (+) strand; PAM type: YTN; PAM sequence: TTT
gactcatcagagtgaggtct

SEQ ID NO: 302123 - DNA, 20 bp, Artificial Sequence
  Description of Artificial Sequence: Synthetic oligonucleotide
  Target: ATXN1; (+) strand; PAM type: YTN; PAM sequence: TTG
actcatcagagtgaggtctg

SEQ ID NO: 302124 - DNA, 20 bp, Artificial Sequence
  Description of Artificial Sequence: Synthetic oligonucleotide
  Target: ATXN1; (+) strand; PAM type: YTN; PAM sequence: CTC
atcagagtgaggtctgaaaa

SEQ ID NO: 302125 - DNA, 20 bp, Artificial Sequence
  Description of Artificial Sequence: Synthetic oligonucleotide
  Target: ATXN1; (+) strand; PAM type: YTN; PAM sequence: CTG
aaaactgtttgtgggtcata

SEQ ID NO: 302126 - DNA, 20 bp, Artificial Sequence
  Description of Artificial Sequence: Synthetic oligonucleotide
  Target: ATXN1; (+) strand; PAM type: YTN; PAM sequence: CTG
tttgtgggtcatagtaaaaa

SEQ ID NO: 302127 - DNA, 20 bp, Artificial Sequence
  Description of Artificial Sequence: Synthetic oligonucleotide
  Target: ATXN1; (+) strand; PAM type: YTN; PAM sequence: TTT
gtgggtcatagtaaaaagag

SEQ ID NO: 302128 - DNA, 20 bp, Artificial Sequence
  Description of Artificial Sequence: Synthetic oligonucleotide
  Target: ATXN1; (+) strand; PAM type: YTN; PAM sequence: TTG
tgggtcatagtaaaaagagt

SEQ ID NO: 302129 - DNA, 20 bp, Artificial Sequence
  Description of Artificial Sequence: Synthetic oligonucleotide
  Target: ATXN1; (+) strand; PAM type: YTN; PAM sequence: TTC
tgaaggacaatgtgacttcc

SEQ ID NO: 302130 - DNA, 20 bp, Artificial Sequence
  Description of Artificial Sequence: Synthetic oligonucleotide
  Target: ATXN1; (+) strand; PAM type: YTN; PAM sequence: CTG
aaggacaatgtgacttccag

SEQ ID NO: 302131 - DNA, 20 bp, Artificial Sequence
  Description of Artificial Sequence: Synthetic oligonucleotide
  Target: ATXN1; (+) strand; PAM type: YTN; PAM sequence: CTT
ccagggagaggtaagccaac

SEQ ID NO: 302132 - DNA, 20 bp, Artificial Sequence
  Description of Artificial Sequence: Synthetic oligonucleotide
  Target: ATXN1; (+) strand; PAM type: YTN; PAM sequence: TTC
cagggagaggtaagccaacc

SEQ ID NO: 302133 - DNA, 20 bp, Artificial Sequence
  Description of Artificial Sequence: Synthetic oligonucleotide
  Target: ATXN1; (+) strand; PAM type: YTN; PAM sequence: CTA
cactgcatgagccagcagag

SEQ ID NO: 302134 - DNA, 20 bp, Artificial Sequence
  Description of Artificial Sequence: Synthetic oligonucleotide
  Target: ATXN1; (+) strand; PAM type: YTN; PAM sequence: CTG
catgagccagcagagcagac

SEQ ID NO: 302135 - DNA, 20 bp, Artificial Sequence
  Description of Artificial Sequence: Synthetic oligonucleotide
  Target: ATXN1; (+) strand; PAM type: YTN; PAM sequence: CTG
aaaggtgataagaagaaaaa

SEQ ID NO: 302136 - DNA, 20 bp, Artificial Sequence
  Description of Artificial Sequence: Synthetic oligonucleotide
  Target: ATXN1; (+) strand; PAM type: YTN; PAM sequence: CTT
gtttttattaacgtaagacc

SEQ ID NO: 302137 - DNA, 20 bp, Artificial Sequence
  Description of Artificial Sequence: Synthetic oligonucleotide
  Target: ATXN1; (+) strand; PAM type: YTN; PAM sequence: TTG
tttttattaacgtaagacct

SEQ ID NO: 302138 - DNA, 20 bp, Artificial Sequence
  Description of Artificial Sequence: Synthetic oligonucleotide
  Target: ATXN1; (+) strand; PAM type: YTN; PAM sequence: TTT
ttattaacgtaagacctcac

SEQ ID NO: 302139 - DNA, 20 bp, Artificial Sequence
  Description of Artificial Sequence: Synthetic oligonucleotide
  Target: ATXN1; (+) strand; PAM type: YTN; PAM sequence: TTT
tattaacgtaagacctcacc

SEQ ID NO: 302140 - DNA, 20 bp, Artificial Sequence
  Description of Artificial Sequence: Synthetic oligonucleotide
  Target: ATXN1; (+) strand; PAM type: YTN; PAM sequence: TTT
attaacgtaagacctcacca

SEQ ID NO: 302141 - DNA, 20 bp, Artificial Sequence
  Description of Artificial Sequence: Synthetic oligonucleotide
  Target: ATXN1; (+) strand; PAM type: YTN; PAM sequence: TTA
ttaacgtaagacctcaccaa

SEQ ID NO: 302142 - DNA, 20 bp, Artificial Sequence
  Description of Artificial Sequence: Synthetic oligonucleotide
  Target: ATXN1; (+) strand; PAM type: YTN; PAM sequence: TTA
acgtaagacctcaccaactt

SEQ ID NO: 302143 - DNA, 20 bp, Artificial Sequence
  Description of Artificial Sequence: Synthetic oligonucleotide
  Target: ATXN1; (+) strand; PAM type: YTN; PAM sequence: CTC
accaacttcctcagacttcc

SEQ ID NO: 302144 - DNA, 20 bp, Artificial Sequence
  Description of Artificial Sequence: Synthetic oligonucleotide
  Target: ATXN1; (+) strand; PAM type: YTN; PAM sequence: CTT
cctcagacttccccaaatga

SEQ ID NO: 302145 - DNA, 20 bp, Artificial Sequence
  Description of Artificial Sequence: Synthetic oligonucleotide
  Target: ATXN1; (+) strand; PAM type: YTN; PAM sequence: TTC
ctcagacttccccaaatgaa

SEQ ID NO: 302146 - DNA, 20 bp, Artificial Sequence
  Description of Artificial Sequence: Synthetic oligonucleotide
  Target: ATXN1; (+) strand; PAM type: YTN; PAM sequence: CTC
agacttccccaaatgaaatg

SEQ ID NO: 302147 - DNA, 20 bp, Artificial Sequence
  Description of Artificial Sequence: Synthetic oligonucleotide
  Target: ATXN1; (+) strand; PAM type: YTN; PAM sequence: CTT
ccccaaatgaaatgtcagac

SEQ ID NO: 302148 - DNA, 20 bp, Artificial Sequence
  Description of Artificial Sequence: Synthetic oligonucleotide
  Target: ATXN1; (+) strand; PAM type: YTN; PAM sequence: TTC
cccaaatgaaatgtcagact

SEQ ID NO: 302149 - DNA, 20 bp, Artificial Sequence
  Description of Artificial Sequence: Synthetic oligonucleotide
  Target: ATXN1; (+) strand; PAM type: YTN; PAM sequence: CTC
gcatgattctgagtaagaat

SEQ ID NO: 302150 - DNA, 20 bp, Artificial Sequence
  Description of Artificial Sequence: Synthetic oligonucleotide
  Target: ATXN1; (+) strand; PAM type: YTN; PAM sequence: TTC
tgagtaagaatcaactgtgt

SEQ ID NO: 302151 - DNA, 20 bp, Artificial Sequence
  Description of Artificial Sequence: Synthetic oligonucleotide
  Target: ATXN1; (+) strand; PAM type: YTN; PAM sequence: CTG
agtaagaatcaactgtgtcc

SEQ ID NO: 302152 - DNA, 20 bp, Artificial Sequence
  Description of Artificial Sequence: Synthetic oligonucleotide
  Target: ATXN1; (+) strand; PAM type: YTN; PAM sequence: CTG
tgtcccttagaagaaaaaca

SEQ ID NO: 302153 - DNA, 20 bp, Artificial Sequence
  Description of Artificial Sequence: Synthetic oligonucleotide
  Target: ATXN1; (+) strand; PAM type: YTN; PAM sequence: CTT
agaagaaaaacatcccaaat

SEQ ID NO: 302154 - DNA, 20 bp, Artificial Sequence
  Description of Artificial Sequence: Synthetic oligonucleotide
  Target: ATXN1; (+) strand; PAM type: YTN; PAM sequence: TTA
gaagaaaaacatcccaaatt

SEQ ID NO: 302155 - DNA, 20 bp, Artificial Sequence
  Description of Artificial Sequence: Synthetic oligonucleotide
  Target: ATXN1; (+) strand; PAM type: YTN; PAM sequence: TTC
agtgataatcgtgggccatt

SEQ ID NO: 302156 - DNA, 20 bp, Artificial Sequence
  Description of Artificial Sequence: Synthetic oligonucleotide
  Target: ATXN1; (+) strand; PAM type: YTN; PAM sequence: TTC
tttttgaccaaatagatttt

SEQ ID NO: 302157 - DNA, 20 bp, Artificial Sequence
  Description of Artificial Sequence: Synthetic oligonucleotide
  Target: ATXN1; (+) strand; PAM type: YTN; PAM sequence: CTT
tttgaccaaatagattttgc

SEQ ID NO: 302158 - DNA, 20 bp, Artificial Sequence
  Description of Artificial Sequence: Synthetic oligonucleotide
  Target: ATXN1; (+) strand; PAM type: YTN; PAM sequence: TTT
ttgaccaaatagattttgct

SEQ ID NO: 302159 - DNA, 20 bp, Artificial Sequence
  Description of Artificial Sequence: Synthetic oligonucleotide
  Target: ATXN1; (+) strand; PAM type: YTN; PAM sequence: TTT
tgaccaaatagattttgctc

SEQ ID NO: 302160 - DNA, 20 bp, Artificial Sequence
  Description of Artificial Sequence: Synthetic oligonucleotide
  Target: ATXN1; (+) strand; PAM type: YTN; PAM sequence: TTT
gaccaaatagattttgctca

SEQ ID NO: 302161 - DNA, 20 bp, Artificial Sequence
  Description of Artificial Sequence: Synthetic oligonucleotide
  Target: ATXN1; (+) strand; PAM type: YTN; PAM sequence: TTG
accaaatagattttgctcac

SEQ ID NO: 302162 - DNA, 20 bp, Artificial Sequence
  Description of Artificial Sequence: Synthetic oligonucleotide
  Target: ATXN1; (+) strand; PAM type: YTN; PAM sequence: TTT
tgctcacgaacattttttta

SEQ ID NO: 302163 - DNA, 20 bp, Artificial Sequence
  Description of Artificial Sequence: Synthetic oligonucleotide
  Target: ATXN1; (+) strand; PAM type: YTN; PAM sequence: TTT
gctcacgaacatttttttaa

SEQ ID NO: 302164 - DNA, 20 bp, Artificial Sequence
  Description of Artificial Sequence: Synthetic oligonucleotide
  Target: ATXN1; (+) strand; PAM type: YTN; PAM sequence: TTG
ctcacgaacatttttttaat

SEQ ID NO: 302165 - DNA, 20 bp, Artificial Sequence
  Description of Artificial Sequence: Synthetic oligonucleotide
  Target: ATXN1; (+) strand; PAM type: YTN; PAM sequence: CTC
acgaacatttttttaatgta

SEQ ID NO: 302166 - DNA, 20 bp, Artificial Sequence
  Description of Artificial Sequence: Synthetic oligonucleotide
  Target: ATXN1; (+) strand; PAM type: YTN; PAM sequence: TTT
ttttaatgtaaatttcccag

SEQ ID NO: 302167 - DNA, 20 bp, Artificial Sequence
  Description of Artificial Sequence: Synthetic oligonucleotide
  Target: ATXN1; (+) strand; PAM type: YTN; PAM sequence: TTT
tttaatgtaaatttcccagt

SEQ ID NO: 302168 - DNA, 20 bp, Artificial Sequence
  Description of Artificial Sequence: Synthetic oligonucleotide
  Target: ATXN1; (+) strand; PAM type: YTN; PAM sequence: TTT
ttaatgtaaatttcccagta

SEQ ID NO: 302169 - DNA, 20 bp, Artificial Sequence
  Description of Artificial Sequence: Synthetic oligonucleotide
  Target: ATXN1; (+) strand; PAM type: YTN; PAM sequence: TTT
taatgtaaatttcccagtag

SEQ ID NO: 302170 - DNA, 20 bp, Artificial Sequence
  Description of Artificial Sequence: Synthetic oligonucleotide
  Target: ATXN1; (+) strand; PAM type: YTN; PAM sequence: TTT
aatgtaaatttcccagtagg

SEQ ID NO: 302171 - DNA, 20 bp, Artificial Sequence
  Description of Artificial Sequence: Synthetic oligonucleotide
  Target: ATXN1; (+) strand; PAM type: YTN; PAM sequence: TTA
atgtaaatttcccagtagga

SEQ ID NO: 302172 - DNA, 20 bp, Artificial Sequence
  Description of Artificial Sequence: Synthetic oligonucleotide
  Target: ATXN1; (+) strand; PAM type: YTN; PAM sequence: TTT
cccagtaggaagcaacacag

SEQ ID NO: 302173 - DNA, 20 bp, Artificial Sequence
  Description of Artificial Sequence: Synthetic oligonucleotide
  Target: ATXN1; (+) strand; PAM type: YTN; PAM sequence: TTC
ccagtaggaagcaacacagt

SEQ ID NO: 302174 - DNA, 20 bp, Artificial Sequence
  Description of Artificial Sequence: Synthetic oligonucleotide
  Target: ATXN1; (+) strand; PAM type: YTN; PAM sequence: TTT
taaaaaataaaattcttaat

SEQ ID NO: 302175 - DNA, 20 bp, Artificial Sequence
  Description of Artificial Sequence: Synthetic oligonucleotide
  Target: ATXN1; (+) strand; PAM type: YTN; PAM sequence: TTT
aaaaaataaaattcttaatc

SEQ ID NO: 302176 - DNA, 20 bp, Artificial Sequence
  Description of Artificial Sequence: Synthetic oligonucleotide
  Target: ATXN1; (+) strand; PAM type: YTN; PAM sequence: TTA
aaaaataaaattcttaatcc

SEQ ID NO: 302177 - DNA, 20 bp, Artificial Sequence
  Description of Artificial Sequence: Synthetic oligonucleotide
  Target: ATXN1; (+) strand; PAM type: YTN; PAM sequence: TTC
ttaatccgctcaggatgaaa

SEQ ID NO: 302178 - DNA, 20 bp, Artificial Sequence
  Description of Artificial Sequence: Synthetic oligonucleotide
  Target: ATXN1; (+) strand; PAM type: YTN; PAM sequence: CTT
aatccgctcaggatgaaaca

SEQ ID NO: 302179 - DNA, 20 bp, Artificial Sequence
  Description of Artificial Sequence: Synthetic oligonucleotide
  Target: ATXN1; (+) strand; PAM type: YTN; PAM sequence: TTA
atccgctcaggatgaaacac

SEQ ID NO: 302180 - DNA, 20 bp, Artificial Sequence
  Description of Artificial Sequence: Synthetic oligonucleotide
  Target: ATXN1; (+) strand; PAM type: YTN; PAM sequence: CTC
aggatgaaacacactactta

SEQ ID NO: 302181 - DNA, 20 bp, Artificial Sequence
  Description of Artificial Sequence: Synthetic oligonucleotide
  Target: ATXN1; (+) strand; PAM type: YTN; PAM sequence: CTA
cttaaaataaactgaatgac

SEQ ID NO: 302182 - DNA, 20 bp, Artificial Sequence
  Description of Artificial Sequence: Synthetic oligonucleotide
  Target: ATXN1; (+) strand; PAM type: YTN; PAM sequence: CTT
aaaataaactgaatgacacc

SEQ ID NO: 302183 - DNA, 20 bp, Artificial Sequence
  Description of Artificial Sequence: Synthetic oligonucleotide
  Target: ATXN1; (+) strand; PAM type: YTN; PAM sequence: TTA
aaataaactgaatgacacct

SEQ ID NO: 302184 - DNA, 20 bp, Artificial Sequence
  Description of Artificial Sequence: Synthetic oligonucleotide
  Target: ATXN1; (+) strand; PAM type: YTN; PAM sequence: CTG
aatgacacctaaaatgatcc

SEQ ID NO: 302185 - DNA, 20 bp, Artificial Sequence
  Description of Artificial Sequence: Synthetic oligonucleotide
  Target: ATXN1; (+) strand; PAM type: YTN; PAM sequence: CTA
aaatgatccgctgaatgaaa

SEQ ID NO: 302186 - DNA, 20 bp, Artificial Sequence
  Description of Artificial Sequence: Synthetic oligonucleotide
  Target: ATXN1; (+) strand; PAM type: YTN; PAM sequence: CTG
aatgaaaagaaaagctattc

SEQ ID NO: 302187 - DNA, 20 bp, Artificial Sequence
  Description of Artificial Sequence: Synthetic oligonucleotide
  Target: ATXN1; (+) strand; PAM type: YTN; PAM sequence: CTA
ttccaagtcacaaaataaac

SEQ ID NO: 302188 - DNA, 20 bp, Artificial Sequence
  Description of Artificial Sequence: Synthetic oligonucleotide
  Target: ATXN1; (+) strand; PAM type: YTN; PAM sequence: TTC
caagtcacaaaataaactat

SEQ ID NO: 302189 - DNA, 20 bp, Artificial Sequence
  Description of Artificial Sequence: Synthetic oligonucleotide
  Target: ATXN1; (+) strand; PAM type: YTN; PAM sequence: CTA
ttattaagccatggaagctt

SEQ ID NO: 302190 - DNA, 20 bp, Artificial Sequence
  Description of Artificial Sequence: Synthetic oligonucleotide
  Target: ATXN1; (+) strand; PAM type: YTN; PAM sequence: TTA
ttaagccatggaagcttact

SEQ ID NO: 302191 - DNA, 20 bp, Artificial Sequence
  Description of Artificial Sequence: Synthetic oligonucleotide
  Target: ATXN1; (+) strand; PAM type: YTN; PAM sequence: TTA
agccatggaagcttactctg

SEQ ID NO: 302192 - DNA, 20 bp, Artificial Sequence
  Description of Artificial Sequence: Synthetic oligonucleotide
  Target: ATXN1; (+) strand; PAM type: YTN; PAM sequence: CTT
actctgtattctcactctcc

SEQ ID NO: 302193 - DNA, 20 bp, Artificial Sequence
  Description of Artificial Sequence: Synthetic oligonucleotide
  Target: ATXN1; (+) strand; PAM type: YTN; PAM sequence: TTA
ctctgtattctcactctcct

SEQ ID NO: 302194 - DNA, 20 bp, Artificial Sequence
  Description of Artificial Sequence: Synthetic oligonucleotide
  Target: ATXN1; (+) strand; PAM type: YTN; PAM sequence: CTC
tgtattctcactctcctttt

SEQ ID NO: 302195 - DNA, 20 bp, Artificial Sequence
  Description of Artificial Sequence: Synthetic oligonucleotide
  Target: ATXN1; (+) strand; PAM type: YTN; PAM sequence: CTG
tattctcactctccttttca

SEQ ID NO: 302196 - DNA, 20 bp, Artificial Sequence
  Description of Artificial Sequence: Synthetic oligonucleotide
  Target: ATXN1; (+) strand; PAM type: YTN; PAM sequence: TTC
tcactctccttttcagtgac

SEQ ID NO: 302197 - DNA, 20 bp, Artificial Sequence
  Description of Artificial Sequence: Synthetic oligonucleotide
  Target: ATXN1; (+) strand; PAM type: YTN; PAM sequence: CTC
actctccttttcagtgacat

SEQ ID NO: 302198 - DNA, 20 bp, Artificial Sequence
  Description of Artificial Sequence: Synthetic oligonucleotide
  Target: ATXN1; (+) strand; PAM type: YTN; PAM sequence: CTC
tccttttcagtgacattttt

SEQ ID NO: 302199 - DNA, 20 bp, Artificial Sequence
  Description of Artificial Sequence: Synthetic oligonucleotide
  Target: ATXN1; (+) strand; PAM type: YTN; PAM sequence: CTC
cttttcagtgacatttttat

SEQ ID NO: 302200 - DNA, 20 bp, Artificial Sequence
  Description of Artificial Sequence: Synthetic oligonucleotide
  Target: ATXN1; (+) strand; PAM type: YTN; PAM sequence: CTT
ttcagtgacatttttatgaa

SEQ ID NO: 302201 - DNA, 20 bp, Artificial Sequence
  Description of Artificial Sequence: Synthetic oligonucleotide
  Target: ATXN1; (+) strand; PAM type: YTN; PAM sequence: TTT
tcagtgacatttttatgaaa

SEQ ID NO: 302202 - DNA, 20 bp, Artificial Sequence
  Description of Artificial Sequence: Synthetic oligonucleotide
  Target: ATXN1; (+) strand; PAM type: YTN; PAM sequence: TTT
cagtgacatttttatgaaac

SEQ ID NO: 302203 - DNA, 20 bp, Artificial Sequence
  Description of Artificial Sequence: Synthetic oligonucleotide
  Target: ATXN1; (+) strand; PAM type: YTN; PAM sequence: TTC
agtgacatttttatgaaaca

SEQ ID NO: 302204 - DNA, 20 bp, Artificial Sequence
  Description of Artificial Sequence: Synthetic oligonucleotide
  Target: ATXN1; (+) strand; PAM type: YTN; PAM sequence: TTT
ttatgaaacacatgtggtag

SEQ ID NO: 302205 - DNA, 20 bp, Artificial Sequence
  Description of Artificial Sequence: Synthetic oligonucleotide
  Target: ATXN1; (+) strand; PAM type: YTN; PAM sequence: TTT
tatgaaacacatgtggtagg

SEQ ID NO: 302206 - DNA, 20 bp, Artificial Sequence
  Description of Artificial Sequence: Synthetic oligonucleotide
  Target: ATXN1; (+) strand; PAM type: YTN; PAM sequence: TTT
atgaaacacatgtggtaggc

SEQ ID NO: 302207 - DNA, 20 bp, Artificial Sequence
  Description of Artificial Sequence: Synthetic oligonucleotide
  Target: ATXN1; (+) strand; PAM type: YTN; PAM sequence: TTA
tgaaacacatgtggtaggca

SEQ ID NO: 302208 - DNA, 20 bp, Artificial Sequence
  Description of Artificial Sequence: Synthetic oligonucleotide
  Target: ATXN1; (+) strand; PAM type: YTN; PAM sequence: TTT
gtgctttgcagcagagaaaa

SEQ ID NO: 302209 - DNA, 20 bp, Artificial Sequence
  Description of Artificial Sequence: Synthetic oligonucleotide
  Target: ATXN1; (+) strand; PAM type: YTN; PAM sequence: TTG
tgctttgcagcagagaaaac

SEQ ID NO: 302210 - DNA, 20 bp, Artificial Sequence
  Description of Artificial Sequence: Synthetic oligonucleotide
  Target: ATXN1; (+) strand; PAM type: YTN; PAM sequence: CTT
tgcagcagagaaaactcaaa

SEQ ID NO: 302211 - DNA, 20 bp, Artificial Sequence
  Description of Artificial Sequence: Synthetic oligonucleotide
  Target: ATXN1; (+) strand; PAM type: YTN; PAM sequence: TTT
gcagcagagaaaactcaaat

SEQ ID NO: 302212 - DNA, 20 bp, Artificial Sequence
  Description of Artificial Sequence: Synthetic oligonucleotide
  Target: ATXN1; (+) strand; PAM type: YTN; PAM sequence: TTG
cagcagagaaaactcaaata

SEQ ID NO: 302213 - DNA, 20 bp, Artificial Sequence
  Description of Artificial Sequence: Synthetic oligonucleotide
  Target: ATXN1; (+) strand; PAM type: YTN; PAM sequence: CTC
aaataatgctttcccaatta

SEQ ID NO: 302214 - DNA, 20 bp, Artificial Sequence
  Description of Artificial Sequence: Synthetic oligonucleotide
  Target: ATXN1; (+) strand; PAM type: YTN; PAM sequence: CTT
tcccaattaaaaaaatcctg

SEQ ID NO: 302215 - DNA, 20 bp, Artificial Sequence
  Description of Artificial Sequence: Synthetic oligonucleotide
  Target: ATXN1; (+) strand; PAM type: YTN; PAM sequence: TTT
cccaattaaaaaaatcctgg

SEQ ID NO: 302216 - DNA, 20 bp, Artificial Sequence
  Description of Artificial Sequence: Synthetic oligonucleotide
  Target: ATXN1; (+) strand; PAM type: YTN; PAM sequence: TTC
ccaattaaaaaaatcctggg

SEQ ID NO: 302217 - DNA, 20 bp, Artificial Sequence
  Description of Artificial Sequence: Synthetic oligonucleotide
  Target: ATXN1; (+) strand; PAM type: YTN; PAM sequence: TTA
aaaaaatcctggggtcttcc

SEQ ID NO: 302218 - DNA, 20 bp, Artificial Sequence
  Description of Artificial Sequence: Synthetic oligonucleotide
  Target: ATXN1; (+) strand; PAM type: YTN; PAM sequence: CTG
gggtcttccaggaccggccc

SEQ ID NO: 302219 - DNA, 20 bp, Artificial Sequence
  Description of Artificial Sequence: Synthetic oligonucleotide
  Target: ATXN1; (+) strand; PAM type: YTN; PAM sequence: CTT
ccaggaccggcccttccttg

SEQ ID NO: 302220 - DNA, 20 bp, Artificial Sequence
  Description of Artificial Sequence: Synthetic oligonucleotide
  Target: ATXN1; (+) strand; PAM type: YTN; PAM sequence: TTC
caggaccggcccttccttgt

SEQ ID NO: 302221 - DNA, 20 bp, Artificial Sequence
  Description of Artificial Sequence: Synthetic oligonucleotide
  Target: ATXN1; (+) strand; PAM type: YTN; PAM sequence: CTT
ccttgttctcctccatgctg

SEQ ID NO: 302222 - DNA, 20 bp, Artificial Sequence
  Description of Artificial Sequence: Synthetic oligonucleotide
  Target: ATXN1; (+) strand; PAM type: YTN; PAM sequence: TTC
cttgttctcctccatgctgg

SEQ ID NO: 302223 - DNA, 20 bp, Artificial Sequence
  Description of Artificial Sequence: Synthetic oligonucleotide
  Target: ATXN1; (+) strand; PAM type: YTN; PAM sequence: CTT
gttctcctccatgctggtca

SEQ ID NO: 302224 - DNA, 20 bp, Artificial Sequence
  Description of Artificial Sequence: Synthetic oligonucleotide
  Target: ATXN1; (+) strand; PAM type: YTN; PAM sequence: TTG
ttctcctccatgctggtcaa

SEQ ID NO: 302225 - DNA, 20 bp, Artificial Sequence
  Description of Artificial Sequence: Synthetic oligonucleotide
  Target: ATXN1; (+) strand; PAM type: YTN; PAM sequence: TTC
tcctccatgctggtcaaact

SEQ ID NO: 302226 - DNA, 20 bp, Artificial Sequence
  Description of Artificial Sequence: Synthetic oligonucleotide
  Target: ATXN1; (+) strand; PAM type: YTN; PAM sequence: CTC
ctccatgctggtcaaactgg

SEQ ID NO: 302227 - DNA, 20 bp, Artificial Sequence
  Description of Artificial Sequence: Synthetic oligonucleotide
  Target: ATXN1; (+) strand; PAM type: YTN; PAM sequence: CTC
catgctggtcaaactggcga

SEQ ID NO: 302228 - DNA, 20 bp, Artificial Sequence
  Description of Artificial Sequence: Synthetic oligonucleotide
  Target: ATXN1; (+) strand; PAM type: YTN; PAM sequence: CTG
gtcaaactggcgatctggac

SEQ ID NO: 302229 - DNA, 20 bp, Artificial Sequence
  Description of Artificial Sequence: Synthetic oligonucleotide
  Target: ATXN1; (+) strand; PAM type: YTN; PAM sequence: CTG
gcgatctggacaggctcttt

SEQ ID NO: 302230 - DNA, 20 bp, Artificial Sequence
  Description of Artificial Sequence: Synthetic oligonucleotide
  Target: ATXN1; (+) strand; PAM type: YTN; PAM sequence: CTG
gacaggctctttggagcaag

SEQ ID NO: 302231 - DNA, 20 bp, Artificial Sequence
  Description of Artificial Sequence: Synthetic oligonucleotide
  Target: ATXN1; (+) strand; PAM type: YTN; PAM sequence: CTC
tttggagcaaggtgctcaac

SEQ ID NO: 302232 - DNA, 20 bp, Artificial Sequence
  Description of Artificial Sequence: Synthetic oligonucleotide
  Target: ATXN1; (+) strand; PAM type: YTN; PAM sequence: CTT
tggagcaaggtgctcaactc

SEQ ID NO: 302233 - DNA, 20 bp, Artificial Sequence
  Description of Artificial Sequence: Synthetic oligonucleotide
  Target: ATXN1; (+) strand; PAM type: YTN; PAM sequence: TTT
ggagcaaggtgctcaactct

SEQ ID NO: 302234 - DNA, 20 bp, Artificial Sequence
  Description of Artificial Sequence: Synthetic oligonucleotide
  Target: ATXN1; (+) strand; PAM type: YTN; PAM sequence: TTG
gagcaaggtgctcaactctt

SEQ ID NO: 302235 - DNA, 20 bp, Artificial Sequence
  Description of Artificial Sequence: Synthetic oligonucleotide
  Target: ATXN1; (+) strand; PAM type: YTN; PAM sequence: CTC
aactcttgaagaatagtatt

SEQ ID NO: 302236 - DNA, 20 bp, Artificial Sequence
  Description of Artificial Sequence: Synthetic oligonucleotide
  Target: ATXN1; (+) strand; PAM type: YTN; PAM sequence: CTC
ttgaagaatagtattggcaa

SEQ ID NO: 302237 - DNA, 20 bp, Artificial Sequence
  Description of Artificial Sequence: Synthetic oligonucleotide
  Target: ATXN1; (+) strand; PAM type: YTN; PAM sequence: CTT
gaagaatagtattggcaagg

SEQ ID NO: 302238 - DNA, 20 bp, Artificial Sequence
  Description of Artificial Sequence: Synthetic oligonucleotide
  Target: ATXN1; (+) strand; PAM type: YTN; PAM sequence: TTG
aagaatagtattggcaagga

SEQ ID NO: 302239 - DNA, 20 bp, Artificial Sequence
  Description of Artificial Sequence: Synthetic oligonucleotide
  Target: ATXN1; (+) strand; PAM type: YTN; PAM sequence: TTG
gcaaggacttggggatgtac

SEQ ID NO: 302240 - DNA, 20 bp, Artificial Sequence
  Description of Artificial Sequence: Synthetic oligonucleotide
  Target: ATXN1; (+) strand; PAM type: YTN; PAM sequence: CTT
ggggatgtacttctctgcat

SEQ ID NO: 302241 - DNA, 20 bp, Artificial Sequence
  Description of Artificial Sequence: Synthetic oligonucleotide
  Target: ATXN1; (+) strand; PAM type: YTN; PAM sequence: TTG
gggatgtacttctctgcatc

SEQ ID NO: 302242 - DNA, 20 bp, Artificial Sequence
  Description of Artificial Sequence: Synthetic oligonucleotide
  Target: ATXN1; (+) strand; PAM type: YTN; PAM sequence: CTT
ctctgcatctggggtgcaga

SEQ ID NO: 302243 - DNA, 20 bp, Artificial Sequence
  Description of Artificial Sequence: Synthetic oligonucleotide
  Target: ATXN1; (+) strand; PAM type: YTN; PAM sequence: TTC
tctgcatctggggtgcagaa

SEQ ID NO: 302244 - DNA, 20 bp, Artificial Sequence
  Description of Artificial Sequence: Synthetic oligonucleotide
  Target: ATXN1; (+) strand; PAM type: YTN; PAM sequence: CTC
tgcatctggggtgcagaaaa

SEQ ID NO: 302245 - DNA, 20 bp, Artificial Sequence
  Description of Artificial Sequence: Synthetic oligonucleotide
  Target: ATXN1; (+) strand; PAM type: YTN; PAM sequence: CTG
catctggggtgcagaaaaga

SEQ ID NO: 302246 - DNA, 20 bp, Artificial Sequence
  Description of Artificial Sequence: Synthetic oligonucleotide
  Target: ATXN1; (+) strand; PAM type: YTN; PAM sequence: CTG
gggtgcagaaaagataagaa

SEQ ID NO: 302247 - DNA, 20 bp, Artificial Sequence
  Description of Artificial Sequence: Synthetic oligonucleotide
  Target: ATXN1; (+) strand; PAM type: YTN; PAM sequence: CTG
atttgcctctgcccctgttc

SEQ ID NO: 302248 - DNA, 20 bp, Artificial Sequence
  Description of Artificial Sequence: Synthetic oligonucleotide
  Target: ATXN1; (+) strand; PAM type: YTN; PAM sequence: TTT
gcctctgcccctgttcttat

SEQ ID NO: 302249 - DNA, 20 bp, Artificial Sequence
  Description of Artificial Sequence: Synthetic oligonucleotide
  Target: ATXN1; (+) strand; PAM type: YTN; PAM sequence: TTG
cctctgcccctgttcttatg

SEQ ID NO: 302250 - DNA, 20 bp, Artificial Sequence
  Description of Artificial Sequence: Synthetic oligonucleotide
  Target: ATXN1; (+) strand; PAM type: YTN; PAM sequence: CTC
tgcccctgttcttatgtttc

SEQ ID NO: 302251 - DNA, 20 bp, Artificial Sequence
  Description of Artificial Sequence: Synthetic oligonucleotide
  Target: ATXN1; (+) strand; PAM type: YTN; PAM sequence: CTG
cccctgttcttatgtttctg

SEQ ID NO: 302252 - DNA, 20 bp, Artificial Sequence
  Description of Artificial Sequence: Synthetic oligonucleotide
  Target: ATXN1; (+) strand; PAM type: YTN; PAM sequence: CTG
ttcttatgtttctgctggtg

SEQ ID NO: 302253 - DNA, 20 bp, Artificial Sequence
  Description of Artificial Sequence: Synthetic oligonucleotide
  Target: ATXN1; (+) strand; PAM type: YTN; PAM sequence: TTC
ttatgtttctgctggtgcat

SEQ ID NO: 302254 - DNA, 20 bp, Artificial Sequence
  Description of Artificial Sequence: Synthetic oligonucleotide
  Target: ATXN1; (+) strand; PAM type: YTN; PAM sequence: CTT
atgtttctgctggtgcatat

SEQ ID NO: 302255 - DNA, 20 bp, Artificial Sequence
  Description of Artificial Sequence: Synthetic oligonucleotide
  Target: ATXN1; (+) strand; PAM type: YTN; PAM sequence: TTA
tgtttctgctggtgcatatc

SEQ ID NO: 302256 - DNA, 20 bp, Artificial Sequence
  Description of Artificial Sequence: Synthetic oligonucleotide
  Target: ATXN1; (+) strand; PAM type: YTN; PAM sequence: TTT
ctgctggtgcatatcttgct

SEQ ID NO: 302257 - DNA, 20 bp, Artificial Sequence
  Description of Artificial Sequence: Synthetic oligonucleotide
  Target: ATXN1; (+) strand; PAM type: YTN; PAM sequence: TTC
tgctggtgcatatcttgctg

SEQ ID NO: 302258 - DNA, 20 bp, Artificial Sequence
  Description of Artificial Sequence: Synthetic oligonucleotide
  Target: ATXN1; (+) strand; PAM type: YTN; PAM sequence: CTG
ctggtgcatatcttgctgtg

SEQ ID NO: 302259 - DNA, 20 bp, Artificial Sequence
  Description of Artificial Sequence: Synthetic oligonucleotide
  Target: ATXN1; (+) strand; PAM type: YTN; PAM sequence: CTG
gtgcatatcttgctgtgctc

SEQ ID NO: 302260 - DNA, 20 bp, Artificial Sequence
  Description of Artificial Sequence: Synthetic oligonucleotide
  Target: ATXN1; (+) strand; PAM type: YTN; PAM sequence: CTT
gctgtgctctgcaaccccca

SEQ ID NO: 302261 - DNA, 20 bp, Artificial Sequence
  Description of Artificial Sequence: Synthetic oligonucleotide
  Target: ATXN1; (+) strand; PAM type: YTN; PAM sequence: TTG
ctgtgctctgcaacccccac

SEQ ID NO: 302262 - DNA, 20 bp, Artificial Sequence
  Description of Artificial Sequence: Synthetic oligonucleotide
  Target: ATXN1; (+) strand; PAM type: YTN; PAM sequence: CTG
tgctctgcaacccccaccag

SEQ ID NO: 302263 - DNA, 20 bp, Artificial Sequence
  Description of Artificial Sequence: Synthetic oligonucleotide
  Target: ATXN1; (+) strand; PAM type: YTN; PAM sequence: CTC
tgcaacccccaccagccgac

SEQ ID NO: 302264 - DNA, 20 bp, Artificial Sequence
  Description of Artificial Sequence: Synthetic oligonucleotide
  Target: ATXN1; (+) strand; PAM type: YTN; PAM sequence: CTG
caacccccaccagccgaccc

SEQ ID NO: 302265 - DNA, 20 bp, Artificial Sequence
  Description of Artificial Sequence: Synthetic oligonucleotide
  Target: ATXN1; (+) strand; PAM type: YTN; PAM sequence: CTT
acggccattcctactcgctg

SEQ ID NO: 302266 - DNA, 20 bp, Artificial Sequence
  Description of Artificial Sequence: Synthetic oligonucleotide
  Target: ATXN1; (+) strand; PAM type: YTN; PAM sequence: TTA
cggccattcctactcgctgc

SEQ ID NO: 302267 - DNA, 20 bp, Artificial Sequence
  Description of Artificial Sequence: Synthetic oligonucleotide
  Target: ATXN1; (+) strand; PAM type: YTN; PAM sequence: TTC
ctactcgctgcctgacaaca

SEQ ID NO: 302268 - DNA, 20 bp, Artificial Sequence
  Description of Artificial Sequence: Synthetic oligonucleotide
  Target: ATXN1; (+) strand; PAM type: YTN; PAM sequence: CTA
ctcgctgcctgacaacatga

SEQ ID NO: 302269 - DNA, 20 bp, Artificial Sequence
  Description of Artificial Sequence: Synthetic oligonucleotide
  Target: ATXN1; (+) strand; PAM type: YTN; PAM sequence: CTC
gctgcctgacaacatgatca

SEQ ID NO: 302270 - DNA, 20 bp, Artificial Sequence
  Description of Artificial Sequence: Synthetic oligonucleotide
  Target: ATXN1; (+) strand; PAM type: YTN; PAM sequence: CTG
cctgacaacatgatcaaagg

SEQ ID NO: 302271 - DNA, 20 bp, Artificial Sequence
  Description of Artificial Sequence: Synthetic oligonucleotide
  Target: ATXN1; (+) strand; PAM type: YTN; PAM sequence: CTG
acaacatgatcaaaggaggg

SEQ ID NO: 302272 - DNA, 20 bp, Artificial Sequence
  Description of Artificial Sequence: Synthetic oligonucleotide
  Target: ATXN1; (+) strand; PAM type: YTN; PAM sequence: TTT
aataaccttaccaggagatc

SEQ ID NO: 302273 - DNA, 20 bp, Artificial Sequence
  Description of Artificial Sequence: Synthetic oligonucleotide
  Target: ATXN1; (+) strand; PAM type: YTN; PAM sequence: TTA
ataaccttaccaggagatca

SEQ ID NO: 302274 - DNA, 20 bp, Artificial Sequence
  Description of Artificial Sequence: Synthetic oligonucleotide
  Target: ATXN1; (+) strand; PAM type: YTN; PAM sequence: CTT
accaggagatcagattgtct

SEQ ID NO: 302275 - DNA, 20 bp, Artificial Sequence
  Description of Artificial Sequence: Synthetic oligonucleotide
  Target: ATXN1; (+) strand; PAM type: YTN; PAM sequence: TTA
ccaggagatcagattgtctg

SEQ ID NO: 302276 - DNA, 20 bp, Artificial Sequence
  Description of Artificial Sequence: Synthetic oligonucleotide
  Target: ATXN1; (+) strand; PAM type: YTN; PAM sequence: TTG
tctggggccaagcagaagtc

SEQ ID NO: 302277 - DNA, 20 bp, Artificial Sequence
  Description of Artificial Sequence: Synthetic oligonucleotide
  Target: ATXN1; (+) strand; PAM type: YTN; PAM sequence: CTG
gggccaagcagaagtcctga

SEQ ID NO: 302278 - DNA, 20 bp, Artificial Sequence
  Description of Artificial Sequence: Synthetic oligonucleotide
  Target: ATXN1; (+) strand; PAM type: YTN; PAM sequence: CTG
agatagctgctgaatcctgg

SEQ ID NO: 302279 - DNA, 20 bp, Artificial Sequence
  Description of Artificial Sequence: Synthetic oligonucleotide
  Target: ATXN1; (+) strand; PAM type: YTN; PAM sequence: CTG
ctgaatcctggccatttaca

SEQ ID NO: 302280 - DNA, 20 bp, Artificial Sequence
  Description of Artificial Sequence: Synthetic oligonucleotide
  Target: ATXN1; (+) strand; PAM type: YTN; PAM sequence: CTG
aatcctggccatttacagag

SEQ ID NO: 302281 - DNA, 20 bp, Artificial Sequence
  Description of Artificial Sequence: Synthetic oligonucleotide
  Target: ATXN1; (+) strand; PAM type: YTN; PAM sequence: CTG
gccatttacagagcagcaca

SEQ ID NO: 302282 - DNA, 20 bp, Artificial Sequence
  Description of Artificial Sequence: Synthetic oligonucleotide
  Target: ATXN1; (+) strand; PAM type: YTN; PAM sequence: TTT
acagagcagcacaaaactag

SEQ ID NO: 302283 - DNA, 20 bp, Artificial Sequence
  Description of Artificial Sequence: Synthetic oligonucleotide
  Target: ATXN1; (+) strand; PAM type: YTN; PAM sequence: TTA
cagagcagcacaaaactagt

SEQ ID NO: 302284 - DNA, 20 bp, Artificial Sequence
  Description of Artificial Sequence: Synthetic oligonucleotide
  Target: ATXN1; (+) strand; PAM type: YTN; PAM sequence: CTA
gtcctgttccttttcctgcc

SEQ ID NO: 302285 - DNA, 20 bp, Artificial Sequence
  Description of Artificial Sequence: Synthetic oligonucleotide
  Target: ATXN1; (+) strand; PAM type: YTN; PAM sequence: CTG
ttccttttcctgccgcggtt

SEQ ID NO: 302286 - DNA, 20 bp, Artificial Sequence
  Description of Artificial Sequence: Synthetic oligonucleotide
  Target: ATXN1; (+) strand; PAM type: YTN; PAM sequence: TTC
cttttcctgccgcggttgcc

SEQ ID NO: 302287 - DNA, 20 bp, Artificial Sequence
  Description of Artificial Sequence: Synthetic oligonucleotide
  Target: ATXN1; (+) strand; PAM type: YTN; PAM sequence: CTT
ttcctgccgcggttgccatg

SEQ ID NO: 302288 - DNA, 20 bp, Artificial Sequence
  Description of Artificial Sequence: Synthetic oligonucleotide
  Target: ATXN1; (+) strand; PAM type: YTN; PAM sequence: TTT
tcctgccgcggttgccatgg

SEQ ID NO: 302289 - DNA, 20 bp, Artificial Sequence
  Description of Artificial Sequence: Synthetic oligonucleotide
  Target: ATXN1; (+) strand; PAM type: YTN; PAM sequence: TTT
cctgccgcggttgccatggc

SEQ ID NO: 302290 - DNA, 20 bp, Artificial Sequence
  Description of Artificial Sequence: Synthetic oligonucleotide
  Target: ATXN1; (+) strand; PAM type: YTN; PAM sequence: TTC
ctgccgcggttgccatggcc

SEQ ID NO: 302291 - DNA, 20 bp, Artificial Sequence
  Description of Artificial Sequence: Synthetic oligonucleotide
  Target: ATXN1; (+) strand; PAM type: YTN; PAM sequence: CTG
ccgcggttgccatggccgac

SEQ ID NO: 302292 - DNA, 20 bp, Artificial Sequence
  Description of Artificial Sequence: Synthetic oligonucleotide
  Target: ATXN1; (+) strand; PAM type: YTN; PAM sequence: TTG
ccatggccgacccaaacaat

SEQ ID NO: 302293 - DNA, 20 bp, Artificial Sequence
  Description of Artificial Sequence: Synthetic oligonucleotide
  Target: ATXN1; (+) strand; PAM type: YTN; PAM sequence: CTT
cagcctcctttggcttccta

SEQ ID NO: 302294 - DNA, 20 bp, Artificial Sequence
  Description of Artificial Sequence: Synthetic oligonucleotide
  Target: ATXN1; (+) strand; PAM type: YTN; PAM sequence: TTC
agcctcctttggcttcctaa

SEQ ID NO: 302295 - DNA, 20 bp, Artificial Sequence
  Description of Artificial Sequence: Synthetic oligonucleotide
  Target: ATXN1; (+) strand; PAM type: YTN; PAM sequence: CTC
ctttggcttcctaaccgcca

SEQ ID NO: 302296 - DNA, 20 bp, Artificial Sequence
  Description of Artificial Sequence: Synthetic oligonucleotide
  Target: ATXN1; (+) strand; PAM type: YTN; PAM sequence: CTT
tggcttcctaaccgccaccc

SEQ ID NO: 302297 - DNA, 20 bp, Artificial Sequence
  Description of Artificial Sequence: Synthetic oligonucleotide
  Target: ATXN1; (+) strand; PAM type: YTN; PAM sequence: TTT
ggcttcctaaccgccaccca

SEQ ID NO: 302298 - DNA, 20 bp, Artificial Sequence
  Description of Artificial Sequence: Synthetic oligonucleotide
  Target: ATXN1; (+) strand; PAM type: YTN; PAM sequence: TTG
gcttcctaaccgccacccac

SEQ ID NO: 302299 - DNA, 20 bp, Artificial Sequence
  Description of Artificial Sequence: Synthetic oligonucleotide
  Target: ATXN1; (+) strand; PAM type: YTN; PAM sequence: CTT
cctaaccgccacccacagac

SEQ ID NO: 302300 - DNA, 20 bp, Artificial Sequence
  Description of Artificial Sequence: Synthetic oligonucleotide
  Target: ATXN1; (+) strand; PAM type: YTN; PAM sequence: TTC
ctaaccgccacccacagacc

SEQ ID NO: 302301 - DNA, 20 bp, Artificial Sequence
  Description of Artificial Sequence: Synthetic oligonucleotide
  Target: ATXN1; (+) strand; PAM type: YTN; PAM sequence: CTA
accgccacccacagacctcc

SEQ ID NO: 302302 - DNA, 20 bp, Artificial Sequence
  Description of Artificial Sequence: Synthetic oligonucleotide
  Target: ATXN1; (+) strand; PAM type: YTN; PAM sequence: CTC
caaacgtgggcaggaggagg

SEQ ID NO: 302303 - DNA, 20 bp, Artificial Sequence
  Description of Artificial Sequence: Synthetic oligonucleotide
  Target: ATXN1; (+) strand; PAM type: YTN; PAM sequence: CTG
ctcaccgatgggaattgagg

SEQ ID NO: 302304 - DNA, 20 bp, Artificial Sequence
  Description of Artificial Sequence: Synthetic oligonucleotide
  Target: ATXN1; (+) strand; PAM type: YTN; PAM sequence: CTC
accgatgggaattgaggagc

SEQ ID NO: 302305 - DNA, 20 bp, Artificial Sequence
  Description of Artificial Sequence: Synthetic oligonucleotide
  Target: ATXN1; (+) strand; PAM type: YTN; PAM sequence: TTG
aggagctaggtagaggatgg

SEQ ID NO: 302306 - DNA, 20 bp, Artificial Sequence
  Description of Artificial Sequence: Synthetic oligonucleotide
  Target: ATXN1; (+) strand; PAM type: YTN; PAM sequence: CTA
ggtagaggatggaaagggga

SEQ ID NO: 302307 - DNA, 20 bp, Artificial Sequence
  Description of Artificial Sequence: Synthetic oligonucleotide
  Target: ATXN1; (+) strand; PAM type: YTN; PAM sequence: CTG
ggctgcagatcagcccggag

SEQ ID NO: 302308 - DNA, 20 bp, Artificial Sequence
  Description of Artificial Sequence: Synthetic oligonucleotide
  Target: ATXN1; (+) strand; PAM type: YTN; PAM sequence: CTG
cagatcagcccggagggtgt

SEQ ID NO: 302309 - DNA, 20 bp, Artificial Sequence
  Description of Artificial Sequence: Synthetic oligonucleotide
  Target: ATXN1; (+) strand; PAM type: YTN; PAM sequence: CTG
cttttagctgctaggctttg

SEQ ID NO: 302310 - DNA, 20 bp, Artificial Sequence
  Description of Artificial Sequence: Synthetic oligonucleotide
  Target: ATXN1; (+) strand; PAM type: YTN; PAM sequence: CTT
ttagctgctaggctttgctt

SEQ ID NO: 302311 - DNA, 20 bp, Artificial Sequence
  Description of Artificial Sequence: Synthetic oligonucleotide
  Target: ATXN1; (+) strand; PAM type: YTN; PAM sequence: TTT
tagctgctaggctttgcttc

SEQ ID NO: 302312 - DNA, 20 bp, Artificial Sequence
  Description of Artificial Sequence: Synthetic oligonucleotide
  Target: ATXN1; (+) strand; PAM type: YTN; PAM sequence: TTT
agctgctaggctttgcttct

SEQ ID NO: 302313 - DNA, 20 bp, Artificial Sequence
  Description of Artificial Sequence: Synthetic oligonucleotide
  Target: ATXN1; (+) strand; PAM type: YTN; PAM sequence: TTA
gctgctaggctttgcttctg

SEQ ID NO: 302314 - DNA, 20 bp, Artificial Sequence
  Description of Artificial Sequence: Synthetic oligonucleotide
  Target: ATXN1; (+) strand; PAM type: YTN; PAM sequence: CTG
ctaggctttgcttctgtgag

SEQ ID NO: 302315 - DNA, 20 bp, Artificial Sequence
  Description of Artificial Sequence: Synthetic oligonucleotide
  Target: ATXN1; (+) strand; PAM type: YTN; PAM sequence: CTA
ggctttgcttctgtgagttt

SEQ ID NO: 302316 - DNA, 20 bp, Artificial Sequence
  Description of Artificial Sequence: Synthetic oligonucleotide
  Target: ATXN1; (+) strand; PAM type: YTN; PAM sequence: CTT
tgcttctgtgagttttcacc

SEQ ID NO: 302317 - DNA, 20 bp, Artificial Sequence
  Description of Artificial Sequence: Synthetic oligonucleotide
  Target: ATXN1; (+) strand; PAM type: YTN; PAM sequence: TTT
gcttctgtgagttttcacct

SEQ ID NO: 302318 - DNA, 20 bp, Artificial Sequence
  Description of Artificial Sequence: Synthetic oligonucleotide
  Target: ATXN1; (+) strand; PAM type: YTN; PAM sequence: TTG
cttctgtgagttttcacctc

SEQ ID NO: 302319 - DNA, 20 bp, Artificial Sequence
  Description of Artificial Sequence: Synthetic oligonucleotide
  Target: ATXN1; (+) strand; PAM type: YTN; PAM sequence: CTT
ctgtgagttttcacctcatt

SEQ ID NO: 302320 - DNA, 20 bp, Artificial Sequence
  Description of Artificial Sequence: Synthetic oligonucleotide
  Target: ATXN1; (+) strand; PAM type: YTN; PAM sequence: TTC
tgtgagttttcacctcattt

SEQ ID NO: 302321 - DNA, 20 bp, Artificial Sequence
  Description of Artificial Sequence: Synthetic oligonucleotide
  Target: ATXN1; (+) strand; PAM type: YTN; PAM sequence: CTG
tgagttttcacctcatttct

SEQ ID NO: 302322 - DNA, 20 bp, Artificial Sequence
  Description of Artificial Sequence: Synthetic oligonucleotide
  Target: ATXN1; (+) strand; PAM type: YTN; PAM sequence: TTT
tcacctcatttctaagtgga

SEQ ID NO: 302323 - DNA, 20 bp, Artificial Sequence
  Description of Artificial Sequence: Synthetic oligonucleotide
  Target: ATXN1; (+) strand; PAM type: YTN; PAM sequence: TTT
cacctcatttctaagtggaa

SEQ ID NO: 302324 - DNA, 20 bp, Artificial Sequence
  Description of Artificial Sequence: Synthetic oligonucleotide
  Target: ATXN1; (+) strand; PAM type: YTN; PAM sequence: TTC
acctcatttctaagtggaaa

SEQ ID NO: 302325 - DNA, 20 bp, Artificial Sequence
  Description of Artificial Sequence: Synthetic oligonucleotide
  Target: ATXN1; (+) strand; PAM type: YTN; PAM sequence: CTC
atttctaagtggaaaacaga

SEQ ID NO: 302326 - DNA, 20 bp, Artificial Sequence
  Description of Artificial Sequence: Synthetic oligonucleotide
  Target: ATXN1; (+) strand; PAM type: YTN; PAM sequence: TTT
ctaagtggaaaacagatctt

SEQ ID NO: 302327 - DNA, 20 bp, Artificial Sequence
  Description of Artificial Sequence: Synthetic oligonucleotide
  Target: ATXN1; (+) strand; PAM type: YTN; PAM sequence: TTC
taagtggaaaacagatctta

SEQ ID NO: 302328 - DNA, 20 bp, Artificial Sequence
  Description of Artificial Sequence: Synthetic oligonucleotide
  Target: ATXN1; (+) strand; PAM type: YTN; PAM sequence: CTA
agtggaaaacagatcttaag

SEQ ID NO: 302329 - DNA, 20 bp, Artificial Sequence
  Description of Artificial Sequence: Synthetic oligonucleotide
  Target: ATXN1; (+) strand; PAM type: YTN; PAM sequence: CTT
aagaagaaaaagaaaccagc

SEQ ID NO: 302330 - DNA, 20 bp, Artificial Sequence
  Description of Artificial Sequence: Synthetic oligonucleotide
  Target: ATXN1; (+) strand; PAM type: YTN; PAM sequence: TTA
agaagaaaaagaaaccagct

SEQ ID NO: 302331 - DNA, 20 bp, Artificial Sequence
  Description of Artificial Sequence: Synthetic oligonucleotide
  Target: ATXN1; (+) strand; PAM type: YTN; PAM sequence: CTA
aaaacccaacatgggacaat

SEQ ID NO: 302332 - DNA, 20 bp, Artificial Sequence
  Description of Artificial Sequence: Synthetic oligonucleotide
  Target: ATXN1; (+) strand; PAM type: YTN; PAM sequence: TTA
ctatcacctttaaactttgg

SEQ ID NO: 302333 - DNA, 20 bp, Artificial Sequence
  Description of Artificial Sequence: Synthetic oligonucleotide
  Target: ATXN1; (+) strand; PAM type: YTN; PAM sequence: CTA
tcacctttaaactttggttt

SEQ ID NO: 302334 - DNA, 20 bp, Artificial Sequence
  Description of Artificial Sequence: Synthetic oligonucleotide
  Target: ATXN1; (+) strand; PAM type: YTN; PAM sequence: CTT
taaactttggttttagcacc

SEQ ID NO: 302335 - DNA, 20 bp, Artificial Sequence
  Description of Artificial Sequence: Synthetic oligonucleotide
  Target: ATXN1; (+) strand; PAM type: YTN; PAM sequence: TTT
aaactttggttttagcacct

SEQ ID NO: 302336 - DNA, 20 bp, Artificial Sequence
  Description of Artificial Sequence: Synthetic oligonucleotide
  Target: ATXN1; (+) strand; PAM type: YTN; PAM sequence: TTA
aactttggttttagcacctt

SEQ ID NO: 302337 - DNA, 20 bp, Artificial Sequence
  Description of Artificial Sequence: Synthetic oligonucleotide
  Target: ATXN1; (+) strand; PAM type: YTN; PAM sequence: CTT
tggttttagcacctttaaac

SEQ ID NO: 302338 - DNA, 20 bp, Artificial Sequence
  Description of Artificial Sequence: Synthetic oligonucleotide
  Target: ATXN1; (+) strand; PAM type: YTN; PAM sequence: TTT
ggttttagcacctttaaact

SEQ ID NO: 302339 - DNA, 20 bp, Artificial Sequence
  Description of Artificial Sequence: Synthetic oligonucleotide
  Target: ATXN1; (+) strand; PAM type: YTN; PAM sequence: TTG
gttttagcacctttaaactc

SEQ ID NO: 302340 - DNA, 20 bp, Artificial Sequence
  Description of Artificial Sequence: Synthetic oligonucleotide
  Target: ATXN1; (+) strand; PAM type: YTN; PAM sequence: TTT
tagcacctttaaactctgga

SEQ ID NO: 302341 - DNA, 20 bp, Artificial Sequence
  Description of Artificial Sequence: Synthetic oligonucleotide
  Target: ATXN1; (+) strand; PAM type: YTN; PAM sequence: TTT
agcacctttaaactctggaa

SEQ ID NO: 302342 - DNA, 20 bp, Artificial Sequence
  Description of Artificial Sequence: Synthetic oligonucleotide
  Target: ATXN1; (+) strand; PAM type: YTN; PAM sequence: TTA
gcacctttaaactctggaat

SEQ ID NO: 302343 - DNA, 20 bp, Artificial Sequence
  Description of Artificial Sequence: Synthetic oligonucleotide
  Target: ATXN1; (+) strand; PAM type: YTN; PAM sequence: CTT
taaactctggaatgaaccgt

SEQ ID NO: 302344 - DNA, 20 bp, Artificial Sequence
  Description of Artificial Sequence: Synthetic oligonucleotide
  Target: ATXN1; (+) strand; PAM type: YTN; PAM sequence: TTT
aaactctggaatgaaccgtg

SEQ ID NO: 302345 - DNA, 20 bp, Artificial Sequence
  Description of Artificial Sequence: Synthetic oligonucleotide
  Target: ATXN1; (+) strand; PAM type: YTN; PAM sequence: TTA
aactctggaatgaaccgtga

SEQ ID NO: 302346 - DNA, 20 bp, Artificial Sequence
  Description of Artificial Sequence: Synthetic oligonucleotide
  Target: ATXN1; (+) strand; PAM type: YTN; PAM sequence: CTC
tggaatgaaccgtgaaccag

SEQ ID NO: 302347 - DNA, 20 bp, Artificial Sequence
  Description of Artificial Sequence: Synthetic oligonucleotide
  Target: ATXN1; (+) strand; PAM type: YTN; PAM sequence: CTG
gaatgaaccgtgaaccagca

SEQ ID NO: 302348 - DNA, 20 bp, Artificial Sequence
  Description of Artificial Sequence: Synthetic oligonucleotide
  Target: ATXN1; (+) strand; PAM type: YTN; PAM sequence: CTC
ctgggtatggtaatatctga

SEQ ID NO: 302349 - DNA, 20 bp, Artificial Sequence
  Description of Artificial Sequence: Synthetic oligonucleotide
  Target: ATXN1; (+) strand; PAM type: YTN; PAM sequence: CTG
ggtatggtaatatctgaaca

SEQ ID NO: 302350 - DNA, 20 bp, Artificial Sequence
  Description of Artificial Sequence: Synthetic oligonucleotide
  Target: ATXN1; (+) strand; PAM type: YTN; PAM sequence: CTG
aacagaagcgaggtttggga

SEQ ID NO: 302351 - DNA, 20 bp, Artificial Sequence
  Description of Artificial Sequence: Synthetic oligonucleotide
  Target: ATXN1; (+) strand; PAM type: YTN; PAM sequence: TTT
gggaggggatgttggcatca

SEQ ID NO: 302352 - DNA, 20 bp, Artificial Sequence
  Description of Artificial Sequence: Synthetic oligonucleotide
  Target: ATXN1; (+) strand; PAM type: YTN; PAM sequence: TTG
ggaggggatgttggcatcag

SEQ ID NO: 302353 - DNA, 20 bp, Artificial Sequence
  Description of Artificial Sequence: Synthetic oligonucleotide
  Target: ATXN1; (+) strand; PAM type: YTN; PAM sequence: TTG
gcatcagggtgataaaccct

SEQ ID NO: 302354 - DNA, 20 bp, Artificial Sequence
  Description of Artificial Sequence: Synthetic oligonucleotide
  Target: ATXN1; (+) strand; PAM type: YTN; PAM sequence: CTA
ggaatggcatacgtgttgtg

SEQ ID NO: 302355 - DNA, 20 bp, Artificial Sequence
  Description of Artificial Sequence: Synthetic oligonucleotide
  Target: ATXN1; (+) strand; PAM type: YTN; PAM sequence: TTG
tgacgttctggtttaaaaca

SEQ ID NO: 302356 - DNA, 20 bp, Artificial Sequence
  Description of Artificial Sequence: Synthetic oligonucleotide
  Target: ATXN1; (+) strand; PAM type: YTN; PAM sequence: TTC
tggtttaaaacaagttccta

SEQ ID NO: 302357 - DNA, 20 bp, Artificial Sequence
  Description of Artificial Sequence: Synthetic oligonucleotide
  Target: ATXN1; (+) strand; PAM type: YTN; PAM sequence: CTG
gtttaaaacaagttcctatt

SEQ ID NO: 302358 - DNA, 20 bp, Artificial Sequence
  Description of Artificial Sequence: Synthetic oligonucleotide
  Target: ATXN1; (+) strand; PAM type: YTN; PAM sequence: TTT
aaaacaagttcctatttgaa

SEQ ID NO: 302359 - DNA, 20 bp, Artificial Sequence
  Description of Artificial Sequence: Synthetic oligonucleotide
  Target: ATXN1; (+) strand; PAM type: YTN; PAM sequence: TTA
aaacaagttcctatttgaag

SEQ ID NO: 302360 - DNA, 20 bp, Artificial Sequence
  Description of Artificial Sequence: Synthetic oligonucleotide
  Target: ATXN1; (+) strand; PAM type: YTN; PAM sequence: TTC
ctatttgaagatgccattaa

SEQ ID NO: 302361 - DNA, 20 bp, Artificial Sequence
  Description of Artificial Sequence: Synthetic oligonucleotide
  Target: ATXN1; (+) strand; PAM type: YTN; PAM sequence: CTA
tttgaagatgccattaaaaa

SEQ ID NO: 302362 - DNA, 20 bp, Artificial Sequence
  Description of Artificial Sequence: Synthetic oligonucleotide
  Target: ATXN1; (+) strand; PAM type: YTN; PAM sequence: TTT
gaagatgccattaaaaaagt

SEQ ID NO: 302363 - DNA, 20 bp, Artificial Sequence
  Description of Artificial Sequence: Synthetic oligonucleotide
  Target: ATXN1; (+) strand; PAM type: YTN; PAM sequence: TTG
aagatgccattaaaaaagtt

SEQ ID NO: 302364 - DNA, 20 bp, Artificial Sequence
  Description of Artificial Sequence: Synthetic oligonucleotide
  Target: ATXN1; (+) strand; PAM type: YTN; PAM sequence: TTA
aaaaagtttagatacagaaa

SEQ ID NO: 302365 - DNA, 20 bp, Artificial Sequence
  Description of Artificial Sequence: Synthetic oligonucleotide
  Target: ATXN1; (+) strand; PAM type: YTN; PAM sequence: TTT
agatacagaaactacacaaa

SEQ ID NO: 302366 - DNA, 20 bp, Artificial Sequence
  Description of Artificial Sequence: Synthetic oligonucleotide
  Target: ATXN1; (+) strand; PAM type: YTN; PAM sequence: TTA
gatacagaaactacacaaag

SEQ ID NO: 302367 - DNA, 20 bp, Artificial Sequence
  Description of Artificial Sequence: Synthetic oligonucleotide
  Target: ATXN1; (+) strand; PAM type: YTN; PAM sequence: CTA
cacaaagaaagagacagagg

SEQ ID NO: 302368 - DNA, 20 bp, Artificial Sequence
  Description of Artificial Sequence: Synthetic oligonucleotide
  Target: ATXN1; (+) strand; PAM type: YTN; PAM sequence: TTA
ccctaaaaataaaccaccaa

SEQ ID NO: 302369 - DNA, 20 bp, Artificial Sequence
  Description of Artificial Sequence: Synthetic oligonucleotide
  Target: ATXN1; (+) strand; PAM type: YTN; PAM sequence: CTA
aaaataaaccaccaatgaat

SEQ ID NO: 302370 - DNA, 20 bp, Artificial Sequence
  Description of Artificial Sequence: Synthetic oligonucleotide
  Target: ATXN1; (+) strand; PAM type: YTN; PAM sequence: TTT
tttatgacacatgttgaaac

SEQ ID NO: 302371 - DNA, 20 bp, Artificial Sequence
  Description of Artificial Sequence: Synthetic oligonucleotide
  Target: ATXN1; (+) strand; PAM type: YTN; PAM sequence: TTT
ttatgacacatgttgaaact

SEQ ID NO: 302372 - DNA, 20 bp, Artificial Sequence
  Description of Artificial Sequence: Synthetic oligonucleotide
  Target: ATXN1; (+) strand; PAM type: YTN; PAM sequence: TTT
tatgacacatgttgaaacta

SEQ ID NO: 302373 - DNA, 20 bp, Artificial Sequence
  Description of Artificial Sequence: Synthetic oligonucleotide
  Target: ATXN1; (+) strand; PAM type: YTN; PAM sequence: TTT
atgacacatgttgaaactaa

SEQ ID NO: 302374 - DNA, 20 bp, Artificial Sequence
  Description of Artificial Sequence: Synthetic oligonucleotide
  Target: ATXN1; (+) strand; PAM type: YTN; PAM sequence: TTA
tgacacatgttgaaactaac

SEQ ID NO: 302375 - DNA, 20 bp, Artificial Sequence
  Description of Artificial Sequence: Synthetic oligonucleotide
  Target: ATXN1; (+) strand; PAM type: YTN; PAM sequence: TTG
aaactaacaacagactagcc

SEQ ID NO: 302376 - DNA, 20 bp, Artificial Sequence
  Description of Artificial Sequence: Synthetic oligonucleotide
  Target: ATXN1; (+) strand; PAM type: YTN; PAM sequence: CTA
acaacagactagcccaggga

SEQ ID NO: 302377 - DNA, 20 bp, Artificial Sequence
  Description of Artificial Sequence: Synthetic oligonucleotide
  Target: ATXN1; (+) strand; PAM type: YTN; PAM sequence: CTA
gcccagggaatggcgctcag

SEQ ID NO: 302378 - DNA, 20 bp, Artificial Sequence
  Description of Artificial Sequence: Synthetic oligonucleotide
  Target: ATXN1; (+) strand; PAM type: YTN; PAM sequence: CTC
aggcgatggagcacctatgc

SEQ ID NO: 302379 - DNA, 20 bp, Artificial Sequence
  Description of Artificial Sequence: Synthetic oligonucleotide
  Target: ATXN1; (+) strand; PAM type: YTN; PAM sequence: CTA
tgctctgggacaagcatggc

SEQ ID NO: 302380 - DNA, 20 bp, Artificial Sequence
  Description of Artificial Sequence: Synthetic oligonucleotide
  Target: ATXN1; (+) strand; PAM type: YTN; PAM sequence: CTC
tgggacaagcatggccactg

SEQ ID NO: 302381 - DNA, 20 bp, Artificial Sequence
  Description of Artificial Sequence: Synthetic oligonucleotide
  Target: ATXN1; (+) strand; PAM type: YTN; PAM sequence: CTG
ggacaagcatggccactgtc

SEQ ID NO: 302382 - DNA, 20 bp, Artificial Sequence
  Description of Artificial Sequence: Synthetic oligonucleotide
  Target: ATXN1; (+) strand; PAM type: YTN; PAM sequence: CTG
tccagctaagcaagccatta

SEQ ID NO: 302383 - DNA, 20 bp, Artificial Sequence
  Description of Artificial Sequence: Synthetic oligonucleotide
  Target: ATXN1; (+) strand; PAM type: YTN; PAM sequence: CTA
agcaagccattaaccctttt

SEQ ID NO: 302384 - DNA, 20 bp, Artificial Sequence
  Description of Artificial Sequence: Synthetic oligonucleotide
  Target: ATXN1; (+) strand; PAM type: YTN; PAM sequence: TTA
acccttttggccattcactt

SEQ ID NO: 302385 - DNA, 20 bp, Artificial Sequence
  Description of Artificial Sequence: Synthetic oligonucleotide
  Target: ATXN1; (+) strand; PAM type: YTN; PAM sequence: CTT
ttggccattcacttcttcat

SEQ ID NO: 302386 - DNA, 20 bp, Artificial Sequence
  Description of Artificial Sequence: Synthetic oligonucleotide
  Target: ATXN1; (+) strand; PAM type: YTN; PAM sequence: TTT
tggccattcacttcttcatc

SEQ ID NO: 302387 - DNA, 20 bp, Artificial Sequence
  Description of Artificial Sequence: Synthetic oligonucleotide
  Target: ATXN1; (+) strand; PAM type: YTN; PAM sequence: TTT
ggccattcacttcttcatct

SEQ ID NO: 302388 - DNA, 20 bp, Artificial Sequence
  Description of Artificial Sequence: Synthetic oligonucleotide
  Target: ATXN1; (+) strand; PAM type: YTN; PAM sequence: TTG
gccattcacttcttcatcta

SEQ ID NO: 302389 - DNA, 20 bp, Artificial Sequence
  Description of Artificial Sequence: Synthetic oligonucleotide
  Target: ATXN1; (+) strand; PAM type: YTN; PAM sequence: TTC
acttcttcatctataaacgg

SEQ ID NO: 302390 - DNA, 20 bp, Artificial Sequence
  Description of Artificial Sequence: Synthetic oligonucleotide
  Target: ATXN1; (+) strand; PAM type: YTN; PAM sequence: CTT
cttcatctataaacggggca

SEQ ID NO: 302391 - DNA, 20 bp, Artificial Sequence
  Description of Artificial Sequence: Synthetic oligonucleotide
  Target: ATXN1; (+) strand; PAM type: YTN; PAM sequence: TTC
ttcatctataaacggggcag

SEQ ID NO: 302392 - DNA, 20 bp, Artificial Sequence
  Description of Artificial Sequence: Synthetic oligonucleotide
  Target: ATXN1; (+) strand; PAM type: YTN; PAM sequence: CTT
catctataaacggggcagag

SEQ ID NO: 302393 - DNA, 20 bp, Artificial Sequence
  Description of Artificial Sequence: Synthetic oligonucleotide
  Target: ATXN1; (+) strand; PAM type: YTN; PAM sequence: TTC
atctataaacggggcagaga

SEQ ID NO: 302394 - DNA, 20 bp, Artificial Sequence
  Description of Artificial Sequence: Synthetic oligonucleotide
  Target: ATXN1; (+) strand; PAM type: YTN; PAM sequence: CTA
taaacggggcagagaagggg

SEQ ID NO: 302395 - DNA, 20 bp, Artificial Sequence
  Description of Artificial Sequence: Synthetic oligonucleotide
  Target: ATXN1; (+) strand; PAM type: YTN; PAM sequence: CTG
tctttaaattcctttacaca

SEQ ID NO: 302396 - DNA, 20 bp, Artificial Sequence
  Description of Artificial Sequence: Synthetic oligonucleotide
  Target: ATXN1; (+) strand; PAM type: YTN; PAM sequence: CTT
taaattcctttacacacaag

SEQ ID NO: 302397 - DNA, 20 bp, Artificial Sequence
  Description of Artificial Sequence: Synthetic oligonucleotide
  Target: ATXN1; (+) strand; PAM type: YTN; PAM sequence: TTT
aaattcctttacacacaaga

SEQ ID NO: 302398 - DNA, 20 bp, Artificial Sequence
  Description of Artificial Sequence: Synthetic oligonucleotide
  Target: ATXN1; (+) strand; PAM type: YTN; PAM sequence: TTA
aattcctttacacacaagac

SEQ ID NO: 302399 - DNA, 20 bp, Artificial Sequence
  Description of Artificial Sequence: Synthetic oligonucleotide
  Target: ATXN1; (+) strand; PAM type: YTN; PAM sequence: TTC
ctttacacacaagacaggga

SEQ ID NO: 302400 - DNA, 20 bp, Artificial Sequence
  Description of Artificial Sequence: Synthetic oligonucleotide
  Target: ATXN1; (+) strand; PAM type: YTN; PAM sequence: CTT
tacacacaagacagggatgc

SEQ ID NO: 302401 - DNA, 20 bp, Artificial Sequence
  Description of Artificial Sequence: Synthetic oligonucleotide
  Target: ATXN1; (+) strand; PAM type: YTN; PAM sequence: TTT
acacacaagacagggatgcc

SEQ ID NO: 302402 - DNA, 20 bp, Artificial Sequence
  Description of Artificial Sequence: Synthetic oligonucleotide
  Target: ATXN1; (+) strand; PAM type: YTN; PAM sequence: TTA
cacacaagacagggatgccc

SEQ ID NO: 302403 - DNA, 20 bp, Artificial Sequence
  Description of Artificial Sequence: Synthetic oligonucleotide
  Target: ATXN1; (+) strand; PAM type: YTN; PAM sequence: CTC
tctcaccactcctattcaac

SEQ ID NO: 302404 - DNA, 20 bp, Artificial Sequence
  Description of Artificial Sequence: Synthetic oligonucleotide
  Target: ATXN1; (+) strand; PAM type: YTN; PAM sequence: CTC
tcaccactcctattcaacat

SEQ ID NO: 302405 - DNA, 20 bp, Artificial Sequence
  Description of Artificial Sequence: Synthetic oligonucleotide
  Target: ATXN1; (+) strand; PAM type: YTN; PAM sequence: CTC
accactcctattcaacatag

SEQ ID NO: 302406 - DNA, 20 bp, Artificial Sequence
  Description of Artificial Sequence: Synthetic oligonucleotide
  Target: ATXN1; (+) strand; PAM type: YTN; PAM sequence: CTC
ctattcaacatagtgttgga

SEQ ID NO: 302407 - DNA, 20 bp, Artificial Sequence
  Description of Artificial Sequence: Synthetic oligonucleotide
  Target: ATXN1; (+) strand; PAM type: YTN; PAM sequence: CTA
ttcaacatagtgttggaagt

SEQ ID NO: 302408 - DNA, 20 bp, Artificial Sequence
  Description of Artificial Sequence: Synthetic oligonucleotide
  Target: ATXN1; (+) strand; PAM type: YTN; PAM sequence: TTC
aacatagtgttggaagttct

SEQ ID NO: 302409 - DNA, 20 bp, Artificial Sequence
  Description of Artificial Sequence: Synthetic oligonucleotide
  Target: ATXN1; (+) strand; PAM type: YTN; PAM sequence: TTG
gaagttctggccagggcaat

SEQ ID NO: 302410 - DNA, 20 bp, Artificial Sequence
  Description of Artificial Sequence: Synthetic oligonucleotide
  Target: ATXN1; (+) strand; PAM type: YTN; PAM sequence: TTC
tggccagggcaatcaggcag

SEQ ID NO: 302411 - DNA, 20 bp, Artificial Sequence
  Description of Artificial Sequence: Synthetic oligonucleotide
  Target: ATXN1; (+) strand; PAM type: YTN; PAM sequence: CTG
gccagggcaatcaggcagga

SEQ ID NO: 302412 - DNA, 20 bp, Artificial Sequence
  Description of Artificial Sequence: Synthetic oligonucleotide
  Target: ATXN1; (+) strand; PAM type: YTN; PAM sequence: TTC
aattaggaaaagaggaagtc

SEQ ID NO: 302413 - DNA, 20 bp, Artificial Sequence
  Description of Artificial Sequence: Synthetic oligonucleotide
  Target: ATXN1; (+) strand; PAM type: YTN; PAM sequence: TTA
ggaaaagaggaagtcaaatt

SEQ ID NO: 302414 - DNA, 20 bp, Artificial Sequence
  Description of Artificial Sequence: Synthetic oligonucleotide
  Target: ATXN1; (+) strand; PAM type: YTN; PAM sequence: TTG
tccctgtttgcagatgacat

SEQ ID NO: 302415 - DNA, 20 bp, Artificial Sequence
  Description of Artificial Sequence: Synthetic oligonucleotide
  Target: ATXN1; (+) strand; PAM type: YTN; PAM sequence: CTG
tttgcagatgacatgatcat

SEQ ID NO: 302416 - DNA, 20 bp, Artificial Sequence
  Description of Artificial Sequence: Synthetic oligonucleotide
  Target: ATXN1; (+) strand; PAM type: YTN; PAM sequence: TTT
gcagatgacatgatcatata

SEQ ID NO: 302417 - DNA, 20 bp, Artificial Sequence
  Description of Artificial Sequence: Synthetic oligonucleotide
  Target: ATXN1; (+) strand; PAM type: YTN; PAM sequence: TTG
cagatgacatgatcatatat

SEQ ID NO: 302418 - DNA, 20 bp, Artificial Sequence
  Description of Artificial Sequence: Synthetic oligonucleotide
  Target: ATXN1; (+) strand; PAM type: YTN; PAM sequence: CTA
gaaaaccccattgtctcagc

SEQ ID NO: 302419 - DNA, 20 bp, Artificial Sequence
  Description of Artificial Sequence: Synthetic oligonucleotide
  Target: ATXN1; (+) strand; PAM type: YTN; PAM sequence: TTG
tctcagcccaaatctcctta

SEQ ID NO: 302420 - DNA, 20 bp, Artificial Sequence
  Description of Artificial Sequence: Synthetic oligonucleotide
  Target: ATXN1; (+) strand; PAM type: YTN; PAM sequence: CTC
agcccaaatctccttaagct

SEQ ID NO: 302421 - DNA, 20 bp, Artificial Sequence
  Description of Artificial Sequence: Synthetic oligonucleotide
  Target: ATXN1; (+) strand; PAM type: YTN; PAM sequence: CTC
cttaagctgataagcaacgt

SEQ ID NO: 302422 - DNA, 20 bp, Artificial Sequence
  Description of Artificial Sequence: Synthetic oligonucleotide
  Target: ATXN1; (+) strand; PAM type: YTN; PAM sequence: CTT
aagctgataagcaacgtcag

SEQ ID NO: 302423 - DNA, 20 bp, Artificial Sequence
  Description of Artificial Sequence: Synthetic oligonucleotide
  Target: ATXN1; (+) strand; PAM type: YTN; PAM sequence: TTA
agctgataagcaacgtcagc

SEQ ID NO: 302424 - DNA, 20 bp, Artificial Sequence
  Description of Artificial Sequence: Synthetic oligonucleotide
  Target: ATXN1; (+) strand; PAM type: YTN; PAM sequence: CTG
ataagcaacgtcagcaaagt

SEQ ID NO: 302425 - DNA, 20 bp, Artificial Sequence
  Description of Artificial Sequence: Synthetic oligonucleotide
  Target: ATXN1; (+) strand; PAM type: YTN; PAM sequence: CTG
aggatacaaaatcaatgtgc

SEQ ID NO: 302426 - DNA, 20 bp, Artificial Sequence
  Description of Artificial Sequence: Synthetic oligonucleotide
  Target: ATXN1; (+) strand; PAM type: YTN; PAM sequence: TTC
ttatacaccactaacagaca

SEQ ID NO: 302427 - DNA, 20 bp, Artificial Sequence
  Description of Artificial Sequence: Synthetic oligonucleotide
  Target: ATXN1; (+) strand; PAM type: YTN; PAM sequence: CTT
atacaccactaacagacaaa

SEQ ID NO: 302428 - DNA, 20 bp, Artificial Sequence
  Description of Artificial Sequence: Synthetic oligonucleotide
  Target: ATXN1; (+) strand; PAM type: YTN; PAM sequence: TTA
tacaccactaacagacaaac

SEQ ID NO: 302429 - DNA, 20 bp, Artificial Sequence
  Description of Artificial Sequence: Synthetic oligonucleotide
  Target: ATXN1; (+) strand; PAM type: YTN; PAM sequence: CTA
acagacaaacagagagccaa

SEQ ID NO: 302430 - DNA, 20 bp, Artificial Sequence
  Description of Artificial Sequence: Synthetic oligonucleotide
  Target: ATXN1; (+) strand; PAM type: YTN; PAM sequence: CTC
ctattcacaactgcttcaaa

SEQ ID NO: 302431 - DNA, 20 bp, Artificial Sequence
  Description of Artificial Sequence: Synthetic oligonucleotide
  Target: ATXN1; (+) strand; PAM type: YTN; PAM sequence: CTA
ttcacaactgcttcaaagag

SEQ ID NO: 302432 - DNA, 20 bp, Artificial Sequence
  Description of Artificial Sequence: Synthetic oligonucleotide
  Target: ATXN1; (+) strand; PAM type: YTN; PAM sequence: TTC
acaactgcttcaaagagaat

SEQ ID NO: 302433 - DNA, 20 bp, Artificial Sequence
  Description of Artificial Sequence: Synthetic oligonucleotide
  Target: ATXN1; (+) strand; PAM type: YTN; PAM sequence: CTG
cttcaaagagaataaaatac

SEQ ID NO: 302434 - DNA, 20 bp, Artificial Sequence
  Description of Artificial Sequence: Synthetic oligonucleotide
  Target: ATXN1; (+) strand; PAM type: YTN; PAM sequence: CTT
caaagagaataaaataccta

SEQ ID NO: 302435 - DNA, 20 bp, Artificial Sequence
  Description of Artificial Sequence: Synthetic oligonucleotide
  Target: ATXN1; (+) strand; PAM type: YTN; PAM sequence: TTC
aaagagaataaaatacctag

SEQ ID NO: 302436 - DNA, 20 bp, Artificial Sequence
  Description of Artificial Sequence: Synthetic oligonucleotide
  Target: ATXN1; (+) strand; PAM type: YTN; PAM sequence: CTA
ggaatccaacttacaaggga

SEQ ID NO: 302437 - DNA, 20 bp, Artificial Sequence
  Description of Artificial Sequence: Synthetic oligonucleotide
  Target: ATXN1; (+) strand; PAM type: YTN; PAM sequence: CTT
acaagggatgtgaagaaccc

SEQ ID NO: 302438 - DNA, 20 bp, Artificial Sequence
  Description of Artificial Sequence: Synthetic oligonucleotide
  Target: ATXN1; (+) strand; PAM type: YTN; PAM sequence: TTA
caagggatgtgaagaacccc

SEQ ID NO: 302439 - DNA, 20 bp, Artificial Sequence
  Description of Artificial Sequence: Synthetic oligonucleotide
  Target: ATXN1; (+) strand; PAM type: YTN; PAM sequence: CTT
caaggagaactacaaaccac

SEQ ID NO: 302440 - DNA, 20 bp, Artificial Sequence
  Description of Artificial Sequence: Synthetic oligonucleotide
  Target: ATXN1; (+) strand; PAM type: YTN; PAM sequence: TTC
aaggagaactacaaaccact

SEQ ID NO: 302441 - DNA, 20 bp, Artificial Sequence
  Description of Artificial Sequence: Synthetic oligonucleotide
  Target: ATXN1; (+) strand; PAM type: YTN; PAM sequence: CTA
caaaccactgctcaacgaaa

SEQ ID NO: 302442 - DNA, 20 bp, Artificial Sequence
  Description of Artificial Sequence: Synthetic oligonucleotide
  Target: ATXN1; (+) strand; PAM type: YTN; PAM sequence: CTG
ctcaacgaaataaaagagga

SEQ ID NO: 302443 - DNA, 20 bp, Artificial Sequence
  Description of Artificial Sequence: Synthetic oligonucleotide
  Target: ATXN1; (+) strand; PAM type: YTN; PAM sequence: CTC
aacgaaataaaagaggatac

SEQ ID NO: 302444 - DNA, 20 bp, Artificial Sequence
  Description of Artificial Sequence: Synthetic oligonucleotide
  Target: ATXN1; (+) strand; PAM type: YTN; PAM sequence: TTC
catgctcatggaaaggaaga

SEQ ID NO: 302445 - DNA, 20 bp, Artificial Sequence
  Description of Artificial Sequence: Synthetic oligonucleotide
  Target: ATXN1; (+) strand; PAM type: YTN; PAM sequence: CTC
atggaaaggaagaagcaata

SEQ ID NO: 302446 - DNA, 20 bp, Artificial Sequence
  Description of Artificial Sequence: Synthetic oligonucleotide
  Target: ATXN1; (+) strand; PAM type: YTN; PAM sequence: CTG
cccaaggtaatttatagatt

SEQ ID NO: 302447 - DNA, 20 bp, Artificial Sequence
  Description of Artificial Sequence: Synthetic oligonucleotide
  Target: ATXN1; (+) strand; PAM type: YTN; PAM sequence: TTT
atagattcaatgccatcccc

SEQ ID NO: 302448 - DNA, 20 bp, Artificial Sequence
  Description of Artificial Sequence: Synthetic oligonucleotide
  Target: ATXN1; (+) strand; PAM type: YTN; PAM sequence: TTA
tagattcaatgccatcccca

SEQ ID NO: 302449 - DNA, 20 bp, Artificial Sequence
  Description of Artificial Sequence: Synthetic oligonucleotide
  Target: ATXN1; (+) strand; PAM type: YTN; PAM sequence: TTC
aatgccatccccatcaagct

SEQ ID NO: 302450 - DNA, 20 bp, Artificial Sequence
  Description of Artificial Sequence: Synthetic oligonucleotide
  Target: ATXN1; (+) strand; PAM type: YTN; PAM sequence: CTA
ccaatgactttcttcacaga

SEQ ID NO: 302451 - DNA, 20 bp, Artificial Sequence
  Description of Artificial Sequence: Synthetic oligonucleotide
  Target: ATXN1; (+) strand; PAM type: YTN; PAM sequence: CTT
tcttcacagaattggaaaaa

SEQ ID NO: 302452 - DNA, 20 bp, Artificial Sequence
  Description of Artificial Sequence: Synthetic oligonucleotide
  Target: ATXN1; (+) strand; PAM type: YTN; PAM sequence: TTT
cttcacagaattggaaaaaa

SEQ ID NO: 302453 - DNA, 20 bp, Artificial Sequence
  Description of Artificial Sequence: Synthetic oligonucleotide
  Target: ATXN1; (+) strand; PAM type: YTN; PAM sequence: TTC
ttcacagaattggaaaaaac

SEQ ID NO: 302454 - DNA, 20 bp, Artificial Sequence
  Description of Artificial Sequence: Synthetic oligonucleotide
  Target: ATXN1; (+) strand; PAM type: YTN; PAM sequence: CTT
cacagaattggaaaaaacta

SEQ ID NO: 302455 - DNA, 20 bp, Artificial Sequence
  Description of Artificial Sequence: Synthetic oligonucleotide
  Target: ATXN1; (+) strand; PAM type: YTN; PAM sequence: TTC
acagaattggaaaaaactac

SEQ ID NO: 302456 - DNA, 20 bp, Artificial Sequence
  Description of Artificial Sequence: Synthetic oligonucleotide
  Target: ATXN1; (+) strand; PAM type: YTN; PAM sequence: TTG
gaaaaaactactttaaagtt

SEQ ID NO: 302457 - DNA, 20 bp, Artificial Sequence
  Description of Artificial Sequence: Synthetic oligonucleotide
  Target: ATXN1; (+) strand; PAM type: YTN; PAM sequence: CTA
ctttaaagttcatatggaac

SEQ ID NO: 302458 - DNA, 20 bp, Artificial Sequence
  Description of Artificial Sequence: Synthetic oligonucleotide
  Target: ATXN1; (+) strand; PAM type: YTN; PAM sequence: CTT
taaagttcatatggaaccaa

SEQ ID NO: 302459 - DNA, 20 bp, Artificial Sequence
  Description of Artificial Sequence: Synthetic oligonucleotide
  Target: ATXN1; (+) strand; PAM type: YTN; PAM sequence: TTT
aaagttcatatggaaccaaa

SEQ ID NO: 302460 - DNA, 20 bp, Artificial Sequence
  Description of Artificial Sequence: Synthetic oligonucleotide
  Target: ATXN1; (+) strand; PAM type: YTN; PAM sequence: TTA
aagttcatatggaaccaaaa

SEQ ID NO: 302461 - DNA, 20 bp, Artificial Sequence
  Description of Artificial Sequence: Synthetic oligonucleotide
  Target: ATXN1; (+) strand; PAM type: YTN; PAM sequence: TTC
atatggaaccaaaaaagagc

SEQ ID NO: 302462 - DNA, 20 bp, Artificial Sequence
  Description of Artificial Sequence: Synthetic oligonucleotide
  Target: ATXN1; (+) strand; PAM type: YTN; PAM sequence: TTG
ccaagtcaatcctaagccaa

SEQ ID NO: 302463 - DNA, 20 bp, Artificial Sequence
  Description of Artificial Sequence: Synthetic oligonucleotide
  Target: ATXN1; (+) strand; PAM type: YTN; PAM sequence: CTA
agccaaaagaacaaagctgg

SEQ ID NO: 302464 - DNA, 20 bp, Artificial Sequence
  Description of Artificial Sequence: Synthetic oligonucleotide
  Target: ATXN1; (+) strand; PAM type: YTN; PAM sequence: CTG
gaggcatcacactacctgac

SEQ ID NO: 302465 - DNA, 20 bp, Artificial Sequence
  Description of Artificial Sequence: Synthetic oligonucleotide
  Target: ATXN1; (+) strand; PAM type: YTN; PAM sequence: CTA
cctgacttcaaactatacta

SEQ ID NO: 302466 - DNA, 20 bp, Artificial Sequence
  Description of Artificial Sequence: Synthetic oligonucleotide
  Target: ATXN1; (+) strand; PAM type: YTN; PAM sequence: CTG
acttcaaactatactacaag

SEQ ID NO: 302467 - DNA, 20 bp, Artificial Sequence
  Description of Artificial Sequence: Synthetic oligonucleotide
  Target: ATXN1; (+) strand; PAM type: YTN; PAM sequence: CTT
caaactatactacaaggcta

SEQ ID NO: 302468 - DNA, 20 bp, Artificial Sequence
  Description of Artificial Sequence: Synthetic oligonucleotide
  Target: ATXN1; (+) strand; PAM type: YTN; PAM sequence: TTC
aaactatactacaaggctac

SEQ ID NO: 302469 - DNA, 20 bp, Artificial Sequence
  Description of Artificial Sequence: Synthetic oligonucleotide
  Target: ATXN1; (+) strand; PAM type: YTN; PAM sequence: CTA
tactacaaggctacagtaat

SEQ ID NO: 302470 - DNA, 20 bp, Artificial Sequence
  Description of Artificial Sequence: Synthetic oligonucleotide
  Target: ATXN1; (+) strand; PAM type: YTN; PAM sequence: CTA
caaggctacagtaatcaaaa

SEQ ID NO: 302471 - DNA, 20 bp, Artificial Sequence
  Description of Artificial Sequence: Synthetic oligonucleotide
  Target: ATXN1; (+) strand; PAM type: YTN; PAM sequence: CTA
cagtaatcaaaacagcatgg

SEQ ID NO: 302472 - DNA, 20 bp, Artificial Sequence
  Description of Artificial Sequence: Synthetic oligonucleotide
  Target: ATXN1; (+) strand; PAM type: YTN; PAM sequence: CTG
gtaccaaaacagagatatag

SEQ ID NO: 302473 - DNA, 20 bp, Artificial Sequence
  Description of Artificial Sequence: Synthetic oligonucleotide
  Target: ATXN1; (+) strand; PAM type: YTN; PAM sequence: CTC
agaaataatgccacacatct

SEQ ID NO: 302474 - DNA, 20 bp, Artificial Sequence
  Description of Artificial Sequence: Synthetic oligonucleotide
  Target: ATXN1; (+) strand; PAM type: YTN; PAM sequence: CTA
caactatccgatctttgaca

SEQ ID NO: 302475 - DNA, 20 bp, Artificial Sequence
  Description of Artificial Sequence: Synthetic oligonucleotide
  Target: ATXN1; (+) strand; PAM type: YTN; PAM sequence: CTA
tccgatctttgacaaacctg

SEQ ID NO: 302476 - DNA, 20 bp, Artificial Sequence
  Description of Artificial Sequence: Synthetic oligonucleotide
  Target: ATXN1; (+) strand; PAM type: YTN; PAM sequence: CTT
tgacaaacctgacaaaaaca

SEQ ID NO: 302477 - DNA, 20 bp, Artificial Sequence
  Description of Artificial Sequence: Synthetic oligonucleotide
  Target: ATXN1; (+) strand; PAM type: YTN; PAM sequence: TTT
gacaaacctgacaaaaacaa

SEQ ID NO: 302478 - DNA, 20 bp, Artificial Sequence
  Description of Artificial Sequence: Synthetic oligonucleotide
  Target: ATXN1; (+) strand; PAM type: YTN; PAM sequence: TTG
acaaacctgacaaaaacaag

SEQ ID NO: 302479 - DNA, 20 bp, Artificial Sequence
  Description of Artificial Sequence: Synthetic oligonucleotide
  Target: ATXN1; (+) strand; PAM type: YTN; PAM sequence: CTG
acaaaaacaagaaatgggga

SEQ ID NO: 302480 - DNA, 20 bp, Artificial Sequence
  Description of Artificial Sequence: Synthetic oligonucleotide
  Target: ATXN1; (+) strand; PAM type: YTN; PAM sequence: TTC
cctatttaataaatggtgct

SEQ ID NO: 302481 - DNA, 20 bp, Artificial Sequence
  Description of Artificial Sequence: Synthetic oligonucleotide
  Target: ATXN1; (+) strand; PAM type: YTN; PAM sequence: CTA
tttaataaatggtgctggga

SEQ ID NO: 302482 - DNA, 20 bp, Artificial Sequence
  Description of Artificial Sequence: Synthetic oligonucleotide
  Target: ATXN1; (+) strand; PAM type: YTN; PAM sequence: TTT
aataaatggtgctgggaaaa

SEQ ID NO: 302483 - DNA, 20 bp, Artificial Sequence
  Description of Artificial Sequence: Synthetic oligonucleotide
  Target: ATXN1; (+) strand; PAM type: YTN; PAM sequence: TTA
ataaatggtgctgggaaaac

SEQ ID NO: 302484 - DNA, 20 bp, Artificial Sequence
  Description of Artificial Sequence: Synthetic oligonucleotide
  Target: ATXN1; (+) strand; PAM type: YTN; PAM sequence: CTG
ggaaaactggctagccatat

SEQ ID NO: 302485 - DNA, 20 bp, Artificial Sequence
  Description of Artificial Sequence: Synthetic oligonucleotide
  Target: ATXN1; (+) strand; PAM type: YTN; PAM sequence: CTG
gctagccatatgtagaaagc

SEQ ID NO: 302486 - DNA, 20 bp, Artificial Sequence
  Description of Artificial Sequence: Synthetic oligonucleotide
  Target: ATXN1; (+) strand; PAM type: YTN; PAM sequence: CTA
gccatatgtagaaagccgaa

SEQ ID NO: 302487 - DNA, 20 bp, Artificial Sequence
  Description of Artificial Sequence: Synthetic oligonucleotide
  Target: ATXN1; (+) strand; PAM type: YTN; PAM sequence: CTG
aaccccttccttacacctta

SEQ ID NO: 302488 - DNA, 20 bp, Artificial Sequence
  Description of Artificial Sequence: Synthetic oligonucleotide
  Target: ATXN1; (+) strand; PAM type: YTN; PAM sequence: CTT
ccttacaccttatacaaaaa

SEQ ID NO: 302489 - DNA, 20 bp, Artificial Sequence
  Description of Artificial Sequence: Synthetic oligonucleotide
  Target: ATXN1; (+) strand; PAM type: YTN; PAM sequence: TTC
cttacaccttatacaaaaat

SEQ ID NO: 302490 - DNA, 20 bp, Artificial Sequence
  Description of Artificial Sequence: Synthetic oligonucleotide
  Target: ATXN1; (+) strand; PAM type: YTN; PAM sequence: CTT
acaccttatacaaaaattaa

SEQ ID NO: 302491 - DNA, 20 bp, Artificial Sequence
  Description of Artificial Sequence: Synthetic oligonucleotide
  Target: ATXN1; (+) strand; PAM type: YTN; PAM sequence: TTA
caccttatacaaaaattaat

SEQ ID NO: 302492 - DNA, 20 bp, Artificial Sequence
  Description of Artificial Sequence: Synthetic oligonucleotide
  Target: ATXN1; (+) strand; PAM type: YTN; PAM sequence: CTT
atacaaaaattaattcaaga

SEQ ID NO: 302493 - DNA, 20 bp, Artificial Sequence
  Description of Artificial Sequence: Synthetic oligonucleotide
  Target: ATXN1; (+) strand; PAM type: YTN; PAM sequence: TTA
tacaaaaattaattcaagat

SEQ ID NO: 302494 - DNA, 20 bp, Artificial Sequence
  Description of Artificial Sequence: Synthetic oligonucleotide
  Target: ATXN1; (+) strand; PAM type: YTN; PAM sequence: TTA
attcaagatggattaaagac

SEQ ID NO: 302495 - DNA, 20 bp, Artificial Sequence
  Description of Artificial Sequence: Synthetic oligonucleotide
  Target: ATXN1; (+) strand; PAM type: YTN; PAM sequence: TTC
aagatggattaaagacttaa

SEQ ID NO: 302496 - DNA, 20 bp, Artificial Sequence
  Description of Artificial Sequence: Synthetic oligonucleotide
  Target: ATXN1; (+) strand; PAM type: YTN; PAM sequence: TTA
aagacttaaatgttagacct

SEQ ID NO: 302497 - DNA, 20 bp, Artificial Sequence
  Description of Artificial Sequence: Synthetic oligonucleotide
  Target: ATXN1; (+) strand; PAM type: YTN; PAM sequence: CTT
aaatgttagacctaaaacca

SEQ ID NO: 302498 - DNA, 20 bp, Artificial Sequence
  Description of Artificial Sequence: Synthetic oligonucleotide
  Target: ATXN1; (+) strand; PAM type: YTN; PAM sequence: TTA
aatgttagacctaaaaccat

SEQ ID NO: 302499 - DNA, 20 bp, Artificial Sequence
  Description of Artificial Sequence: Synthetic oligonucleotide
  Target: ATXN1; (+) strand; PAM type: YTN; PAM sequence: TTA
gacctaaaaccataaaaacc

SEQ ID NO: 302500 - DNA, 20 bp, Artificial Sequence
  Description of Artificial Sequence: Synthetic oligonucleotide
  Target: ATXN1; (+) strand; PAM type: YTN; PAM sequence: CTA
aaaccataaaaaccctagaa

SEQ ID NO: 302501 - DNA, 20 bp, Artificial Sequence
  Description of Artificial Sequence: Synthetic oligonucleotide
  Target: ATXN1; (+) strand; PAM type: YTN; PAM sequence: CTA
gaagaaaacctaggcaatac

SEQ ID NO: 302502 - DNA, 20 bp, Artificial Sequence
  Description of Artificial Sequence: Synthetic oligonucleotide
  Target: ATXN1; (+) strand; PAM type: YTN; PAM sequence: CTA
ggcaataccattcaggacat

SEQ ID NO: 302503 - DNA, 20 bp, Artificial Sequence
  Description of Artificial Sequence: Synthetic oligonucleotide
  Target: ATXN1; (+) strand; PAM type: YTN; PAM sequence: TTC
aggacataggcatgggcaac

SEQ ID NO: 302504 - DNA, 20 bp, Artificial Sequence
  Description of Artificial Sequence: Synthetic oligonucleotide
  Target: ATXN1; (+) strand; PAM type: YTN; PAM sequence: CTT
catgtctaaaacaccaaaag

SEQ ID NO: 302505 - DNA, 20 bp, Artificial Sequence
  Description of Artificial Sequence: Synthetic oligonucleotide
  Target: ATXN1; (+) strand; PAM type: YTN; PAM sequence: TTC
atgtctaaaacaccaaaagc

SEQ ID NO: 302506 - DNA, 20 bp, Artificial Sequence
  Description of Artificial Sequence: Synthetic oligonucleotide
  Target: ATXN1; (+) strand; PAM type: YTN; PAM sequence: CTA
aaacaccaaaagcaatggca

SEQ ID NO: 302507 - DNA, 20 bp, Artificial Sequence
  Description of Artificial Sequence: Synthetic oligonucleotide
  Target: ATXN1; (+) strand; PAM type: YTN; PAM sequence: TTG
tcaaatgggatctaattaaa

SEQ ID NO: 302508 - DNA, 20 bp, Artificial Sequence
  Description of Artificial Sequence: Synthetic oligonucleotide
  Target: ATXN1; (+) strand; PAM type: YTN; PAM sequence: CTA
attaaactaaagagcttctg

SEQ ID NO: 302509 - DNA, 20 bp, Artificial Sequence
  Description of Artificial Sequence: Synthetic oligonucleotide
  Target: ATXN1; (+) strand; PAM type: YTN; PAM sequence: TTA
aactaaagagcttctgcaca

SEQ ID NO: 302510 - DNA, 20 bp, Artificial Sequence
  Description of Artificial Sequence: Synthetic oligonucleotide
  Target: ATXN1; (+) strand; PAM type: YTN; PAM sequence: CTA
aagagcttctgcacagccaa

SEQ ID NO: 302511 - DNA, 20 bp, Artificial Sequence
  Description of Artificial Sequence: Synthetic oligonucleotide
  Target: ATXN1; (+) strand; PAM type: YTN; PAM sequence: CTT
ctgcacagccaaagaaacta

SEQ ID NO: 302512 - DNA, 20 bp, Artificial Sequence
  Description of Artificial Sequence: Synthetic oligonucleotide
  Target: ATXN1; (+) strand; PAM type: YTN; PAM sequence: TTC
tgcacagccaaagaaactac

SEQ ID NO: 302513 - DNA, 20 bp, Artificial Sequence
  Description of Artificial Sequence: Synthetic oligonucleotide
  Target: ATXN1; (+) strand; PAM type: YTN; PAM sequence: CTG
cacagccaaagaaactacca

SEQ ID NO: 302514 - DNA, 20 bp, Artificial Sequence
  Description of Artificial Sequence: Synthetic oligonucleotide
  Target: ATXN1; (+) strand; PAM type: YTN; PAM sequence: CTA
ccatcggagtgaacaggcaa

SEQ ID NO: 302515 - DNA, 20 bp, Artificial Sequence
  Description of Artificial Sequence: Synthetic oligonucleotide
  Target: ATXN1; (+) strand; PAM type: YTN; PAM sequence: CTA
cagaatgggagaaaattttt

SEQ ID NO: 302516 - DNA, 20 bp, Artificial Sequence
  Description of Artificial Sequence: Synthetic oligonucleotide
  Target: ATXN1; (+) strand; PAM type: YTN; PAM sequence: TTT
ttgcaatctactcatcggac

SEQ ID NO: 302517 - DNA, 20 bp, Artificial Sequence
  Description of Artificial Sequence: Synthetic oligonucleotide
  Target: ATXN1; (+) strand; PAM type: YTN; PAM sequence: TTT
tgcaatctactcatcggaca

SEQ ID NO: 302518 - DNA, 20 bp, Artificial Sequence
  Description of Artificial Sequence: Synthetic oligonucleotide
  Target: ATXN1; (+) strand; PAM type: YTN; PAM sequence: TTT
gcaatctactcatcggacaa

SEQ ID NO: 302519 - DNA, 20 bp, Artificial Sequence
  Description of Artificial Sequence: Synthetic oligonucleotide
  Target: ATXN1; (+) strand; PAM type: YTN; PAM sequence: TTG
caatctactcatcggacaaa

SEQ ID NO: 302520 - DNA, 20 bp, Artificial Sequence
  Description of Artificial Sequence: Synthetic oligonucleotide
  Target: ATXN1; (+) strand; PAM type: YTN; PAM sequence: CTA
ctcatcggacaaagggctaa

SEQ ID NO: 302521 - DNA, 20 bp, Artificial Sequence
  Description of Artificial Sequence: Synthetic oligonucleotide
  Target: ATXN1; (+) strand; PAM type: YTN; PAM sequence: CTC
atcggacaaagggctaatat

SEQ ID NO: 302522 - DNA, 20 bp, Artificial Sequence
  Description of Artificial Sequence: Synthetic oligonucleotide
  Target: ATXN1; (+) strand; PAM type: YTN; PAM sequence: CTA
atatccagaatctacaaaga

SEQ ID NO: 302523 - DNA, 20 bp, Artificial Sequence
  Description of Artificial Sequence: Synthetic oligonucleotide
  Target: ATXN1; (+) strand; PAM type: YTN; PAM sequence: CTA
caaagaactcaaacaaattt

SEQ ID NO: 302524 - DNA, 20 bp, Artificial Sequence
  Description of Artificial Sequence: Synthetic oligonucleotide
  Target: ATXN1; (+) strand; PAM type: YTN; PAM sequence: CTC
aaacaaatttacaagaaaaa

SEQ ID NO: 302525 - DNA, 20 bp, Artificial Sequence
  Description of Artificial Sequence: Synthetic oligonucleotide
  Target: ATXN1; (+) strand; PAM type: YTN; PAM sequence: TTT
acaagaaaaaaacaaacaac

SEQ ID NO: 302526 - DNA, 20 bp, Artificial Sequence
  Description of Artificial Sequence: Synthetic oligonucleotide
  Target: ATXN1; (+) strand; PAM type: YTN; PAM sequence: TTA
caagaaaaaaacaaacaacc

SEQ ID NO: 302527 - DNA, 20 bp, Artificial Sequence
  Description of Artificial Sequence: Synthetic oligonucleotide
  Target: ATXN1; (+) strand; PAM type: YTN; PAM sequence: CTT
ctcaaaagaagacatttatg

SEQ ID NO: 302528 - DNA, 20 bp, Artificial Sequence
  Description of Artificial Sequence: Synthetic oligonucleotide
  Target: ATXN1; (+) strand; PAM type: YTN; PAM sequence: TTC
tcaaaagaagacatttatgc

SEQ ID NO: 302529 - DNA, 20 bp, Artificial Sequence
  Description of Artificial Sequence: Synthetic oligonucleotide
  Target: ATXN1; (+) strand; PAM type: YTN; PAM sequence: CTC
aaaagaagacatttatgcag

SEQ ID NO: 302530 - DNA, 20 bp, Artificial Sequence
  Description of Artificial Sequence: Synthetic oligonucleotide
  Target: ATXN1; (+) strand; PAM type: YTN; PAM sequence: TTT
atgcagccaaaagacaaaaa

SEQ ID NO: 302531 - DNA, 20 bp, Artificial Sequence
  Description of Artificial Sequence: Synthetic oligonucleotide
  Target: ATXN1; (+) strand; PAM type: YTN; PAM sequence: TTA
tgcagccaaaagacaaaaaa

SEQ ID NO: 302532 - DNA, 20 bp, Artificial Sequence
  Description of Artificial Sequence: Synthetic oligonucleotide
  Target: ATXN1; (+) strand; PAM type: YTN; PAM sequence: CTC
atcatcactggccatcagag

SEQ ID NO: 302533 - DNA, 20 bp, Artificial Sequence
  Description of Artificial Sequence: Synthetic oligonucleotide
  Target: ATXN1; (+) strand; PAM type: YTN; PAM sequence: CTG
gccatcagagaaatgcaaat

SEQ ID NO: 302534 - DNA, 20 bp, Artificial Sequence
  Description of Artificial Sequence: Synthetic oligonucleotide
  Target: ATXN1; (+) strand; PAM type: YTN; PAM sequence: CTC
acaccagttagaatggcaat

SEQ ID NO: 302535 - DNA, 20 bp, Artificial Sequence
  Description of Artificial Sequence: Synthetic oligonucleotide
  Target: ATXN1; (+) strand; PAM type: YTN; PAM sequence: TTA
gaatggcaatcattaaaaag

SEQ ID NO: 302536 - DNA, 20 bp, Artificial Sequence
  Description of Artificial Sequence: Synthetic oligonucleotide
  Target: ATXN1; (+) strand; PAM type: YTN; PAM sequence: TTA
aaaagtcaggaaacaacagg

SEQ ID NO: 302537 - DNA, 20 bp, Artificial Sequence
  Description of Artificial Sequence: Synthetic oligonucleotide
  Target: ATXN1; (+) strand; PAM type: YTN; PAM sequence: CTG
gagaggatgtggagacatag

SEQ ID NO: 302538 - DNA, 20 bp, Artificial Sequence
  Description of Artificial Sequence: Synthetic oligonucleotide
  Target: ATXN1; (+) strand; PAM type: YTN; PAM sequence: TTT
ttacactgtttgtgggactg

SEQ ID NO: 302539 - DNA, 20 bp, Artificial Sequence
  Description of Artificial Sequence: Synthetic oligonucleotide
  Target: ATXN1; (+) strand; PAM type: YTN; PAM sequence: TTT
tacactgtttgtgggactgt

SEQ ID NO: 302540 - DNA, 20 bp, Artificial Sequence
  Description of Artificial Sequence: Synthetic oligonucleotide
  Target: ATXN1; (+) strand; PAM type: YTN; PAM sequence: TTT
acactgtttgtgggactgta

SEQ ID NO: 302541 - DNA, 20 bp, Artificial Sequence
  Description of Artificial Sequence: Synthetic oligonucleotide
  Target: ATXN1; (+) strand; PAM type: YTN; PAM sequence: TTA
cactgtttgtgggactgtaa

SEQ ID NO: 302542 - DNA, 20 bp, Artificial Sequence
  Description of Artificial Sequence: Synthetic oligonucleotide
  Target: ATXN1; (+) strand; PAM type: YTN; PAM sequence: CTG
tttgtgggactgtaaactag

SEQ ID NO: 302543 - DNA, 20 bp, Artificial Sequence
  Description of Artificial Sequence: Synthetic oligonucleotide
  Target: ATXN1; (+) strand; PAM type: YTN; PAM sequence: TTT
gtgggactgtaaactagttc

SEQ ID NO: 302544 - DNA, 20 bp, Artificial Sequence
  Description of Artificial Sequence: Synthetic oligonucleotide
  Target: ATXN1; (+) strand; PAM type: YTN; PAM sequence: TTG
tgggactgtaaactagttca

SEQ ID NO: 302545 - DNA, 20 bp, Artificial Sequence
  Description of Artificial Sequence: Synthetic oligonucleotide
  Target: ATXN1; (+) strand; PAM type: YTN; PAM sequence: CTG
taaactagttcaaccattgt

SEQ ID NO: 302546 - DNA, 20 bp, Artificial Sequence
  Description of Artificial Sequence: Synthetic oligonucleotide
  Target: ATXN1; (+) strand; PAM type: YTN; PAM sequence: CTA
gttcaaccattgtggaagtc

SEQ ID NO: 302547 - DNA, 20 bp, Artificial Sequence
  Description of Artificial Sequence: Synthetic oligonucleotide
  Target: ATXN1; (+) strand; PAM type: YTN; PAM sequence: TTC
aaccattgtggaagtcagtg

SEQ ID NO: 302548 - DNA, 20 bp, Artificial Sequence
  Description of Artificial Sequence: Synthetic oligonucleotide
  Target: ATXN1; (+) strand; PAM type: YTN; PAM sequence: TTG
tggaagtcagtgtggcgatt

SEQ ID NO: 302549 - DNA, 20 bp, Artificial Sequence
  Description of Artificial Sequence: Synthetic oligonucleotide
  Target: ATXN1; (+) strand; PAM type: YTN; PAM sequence: TTC
ctcagggatctagaactaga

SEQ ID NO: 302550 - DNA, 20 bp, Artificial Sequence
  Description of Artificial Sequence: Synthetic oligonucleotide
  Target: ATXN1; (+) strand; PAM type: YTN; PAM sequence: CTC
agggatctagaactagaaat

SEQ ID NO: 302551 - DNA, 20 bp, Artificial Sequence
  Description of Artificial Sequence: Synthetic oligonucleotide
  Target: ATXN1; (+) strand; PAM type: YTN; PAM sequence: CTA
gaactagaaataccatttga

SEQ ID NO: 302552 - DNA, 20 bp, Artificial Sequence
  Description of Artificial Sequence: Synthetic oligonucleotide
  Target: ATXN1; (+) strand; PAM type: YTN; PAM sequence: CTA
gaaataccatttgacccagc

SEQ ID NO: 302553 - DNA, 20 bp, Artificial Sequence
  Description of Artificial Sequence: Synthetic oligonucleotide
  Target: ATXN1; (+) strand; PAM type: YTN; PAM sequence: TTT
gacccagccatcccattact

SEQ ID NO: 302554 - DNA, 20 bp, Artificial Sequence
  Description of Artificial Sequence: Synthetic oligonucleotide
  Target: ATXN1; (+) strand; PAM type: YTN; PAM sequence: TTG
acccagccatcccattactg

SEQ ID NO: 302555 - DNA, 20 bp, Artificial Sequence
  Description of Artificial Sequence: Synthetic oligonucleotide
  Target: ATXN1; (+) strand; PAM type: YTN; PAM sequence: TTA
ctgggtatataccaaaagga

SEQ ID NO: 302556 - DNA, 20 bp, Artificial Sequence
  Description of Artificial Sequence: Synthetic oligonucleotide
  Target: ATXN1; (+) strand; PAM type: YTN; PAM sequence: CTG
ggtatataccaaaaggagta

SEQ ID NO: 302557 - DNA, 20 bp, Artificial Sequence
  Description of Artificial Sequence: Synthetic oligonucleotide
  Target: ATXN1; (+) strand; PAM type: YTN; PAM sequence: CTG
ctataaagacacatgcacac

SEQ ID NO: 302558 - DNA, 20 bp, Artificial Sequence
  Description of Artificial Sequence: Synthetic oligonucleotide
  Target: ATXN1; (+) strand; PAM type: YTN; PAM sequence: CTA
taaagacacatgcacacgta

SEQ ID NO: 302559 - DNA, 20 bp, Artificial Sequence
  Description of Artificial Sequence: Synthetic oligonucleotide
  Target: ATXN1; (+) strand; PAM type: YTN; PAM sequence: TTT
attgcggcactattcacaat

SEQ ID NO: 302560 - DNA, 20 bp, Artificial Sequence
  Description of Artificial Sequence: Synthetic oligonucleotide
  Target: ATXN1; (+) strand; PAM type: YTN; PAM sequence: TTA
ttgcggcactattcacaata

SEQ ID NO: 302561 - DNA, 20 bp, Artificial Sequence
  Description of Artificial Sequence: Synthetic oligonucleotide
  Target: ATXN1; (+) strand; PAM type: YTN; PAM sequence: TTG
cggcactattcacaatagca

SEQ ID NO: 302562 - DNA, 20 bp, Artificial Sequence
  Description of Artificial Sequence: Synthetic oligonucleotide
  Target: ATXN1; (+) strand; PAM type: YTN; PAM sequence: CTA
ttcacaatagcaaagacttg

SEQ ID NO: 302563 - DNA, 20 bp, Artificial Sequence
  Description of Artificial Sequence: Synthetic oligonucleotide
  Target: ATXN1; (+) strand; PAM type: YTN; PAM sequence: TTC
acaatagcaaagacttggaa

SEQ ID NO: 302564 - DNA, 20 bp, Artificial Sequence
  Description of Artificial Sequence: Synthetic oligonucleotide
  Target: ATXN1; (+) strand; PAM type: YTN; PAM sequence: CTT
ggaaccaacccaaatgtcca

SEQ ID NO: 302565 - DNA, 20 bp, Artificial Sequence
  Description of Artificial Sequence: Synthetic oligonucleotide
  Target: ATXN1; (+) strand; PAM type: YTN; PAM sequence: TTG
gaaccaacccaaatgtccaa

SEQ ID NO: 302566 - DNA, 20 bp, Artificial Sequence
  Description of Artificial Sequence: Synthetic oligonucleotide
  Target: ATXN1; (+) strand; PAM type: YTN; PAM sequence: CTG
cattaagaaaatgtggcaca

SEQ ID NO: 302567 - DNA, 20 bp, Artificial Sequence
  Description of Artificial Sequence: Synthetic oligonucleotide
  Target: ATXN1; (+) strand; PAM type: YTN; PAM sequence: TTA
agaaaatgtggcacatacac

SEQ ID NO: 302568 - DNA, 20 bp, Artificial Sequence
  Description of Artificial Sequence: Synthetic oligonucleotide
  Target: ATXN1; (+) strand; PAM type: YTN; PAM sequence: CTA
tgcagccataaaaaatgatg

SEQ ID NO: 302569 - DNA, 20 bp, Artificial Sequence
  Description of Artificial Sequence: Synthetic oligonucleotide
  Target: ATXN1; (+) strand; PAM type: YTN; PAM sequence: TTC
atgtcctttgtagggacatg

SEQ ID NO: 302570 - DNA, 20 bp, Artificial Sequence
  Description of Artificial Sequence: Synthetic oligonucleotide
  Target: ATXN1; (+) strand; PAM type: YTN; PAM sequence: CTT
tgtagggacatggatgaagc

SEQ ID NO: 302571 - DNA, 20 bp, Artificial Sequence
  Description of Artificial Sequence: Synthetic oligonucleotide
  Target: ATXN1; (+) strand; PAM type: YTN; PAM sequence: TTT
gtagggacatggatgaagct

SEQ ID NO: 302572 - DNA, 20 bp, Artificial Sequence
  Description of Artificial Sequence: Synthetic oligonucleotide
  Target: ATXN1; (+) strand; PAM type: YTN; PAM sequence: TTG
tagggacatggatgaagctg

SEQ ID NO: 302573 - DNA, 20 bp, Artificial Sequence
  Description of Artificial Sequence: Synthetic oligonucleotide
  Target: ATXN1; (+) strand; PAM type: YTN; PAM sequence: CTG
gaaaccatcattctcagcaa

SEQ ID NO: 302574 - DNA, 20 bp, Artificial Sequence
  Description of Artificial Sequence: Synthetic oligonucleotide
  Target: ATXN1; (+) strand; PAM type: YTN; PAM sequence: TTC
tcagcaaactatcgcaagga

SEQ ID NO: 302575 - DNA, 20 bp, Artificial Sequence
  Description of Artificial Sequence: Synthetic oligonucleotide
  Target: ATXN1; (+) strand; PAM type: YTN; PAM sequence: CTC
agcaaactatcgcaaggaca

SEQ ID NO: 302576 - DNA, 20 bp, Artificial Sequence
  Description of Artificial Sequence: Synthetic oligonucleotide
  Target: ATXN1; (+) strand; PAM type: YTN; PAM sequence: CTA
tcgcaaggacaaaaaaccaa

SEQ ID NO: 302577 - DNA, 20 bp, Artificial Sequence
  Description of Artificial Sequence: Synthetic oligonucleotide
  Target: ATXN1; (+) strand; PAM type: YTN; PAM sequence: TTC
tcactcataggtgggaattg

SEQ ID NO: 302578 - DNA, 20 bp, Artificial Sequence
  Description of Artificial Sequence: Synthetic oligonucleotide
  Target: ATXN1; (+) strand; PAM type: YTN; PAM sequence: CTC
actcataggtgggaattgaa

SEQ ID NO: 302579 - DNA, 20 bp, Artificial Sequence
  Description of Artificial Sequence: Synthetic oligonucleotide
  Target: ATXN1; (+) strand; PAM type: YTN; PAM sequence: CTC
ataggtgggaattgaacaat

SEQ ID NO: 302580 - DNA, 20 bp, Artificial Sequence
  Description of Artificial Sequence: Synthetic oligonucleotide
  Target: ATXN1; (+) strand; PAM type: YTN; PAM sequence: TTG
aacaatgagaacacttgggc

SEQ ID NO: 302581 - DNA, 20 bp, Artificial Sequence
  Description of Artificial Sequence: Synthetic oligonucleotide
  Target: ATXN1; (+) strand; PAM type: YTN; PAM sequence: CTT
gggcacaggaaggggaacac

SEQ ID NO: 302582 - DNA, 20 bp, Artificial Sequence
  Description of Artificial Sequence: Synthetic oligonucleotide
  Target: ATXN1; (+) strand; PAM type: YTN; PAM sequence: TTG
ggcacaggaaggggaacacc

SEQ ID NO: 302583 - DNA, 20 bp, Artificial Sequence
  Description of Artificial Sequence: Synthetic oligonucleotide
  Target: ATXN1; (+) strand; PAM type: YTN; PAM sequence: CTG
ttgtggggtggggggaaggg

SEQ ID NO: 302584 - DNA, 20 bp, Artificial Sequence
  Description of Artificial Sequence: Synthetic oligonucleotide
  Target: ATXN1; (+) strand; PAM type: YTN; PAM sequence: TTG
tggggtggggggaaggggga

SEQ ID NO: 302585 - DNA, 20 bp, Artificial Sequence
  Description of Artificial Sequence: Synthetic oligonucleotide
  Target: ATXN1; (+) strand; PAM type: YTN; PAM sequence: TTA
ggagatatacctaatgtaaa

SEQ ID NO: 302586 - DNA, 20 bp, Artificial Sequence
  Description of Artificial Sequence: Synthetic oligonucleotide
  Target: ATXN1; (+) strand; PAM type: YTN; PAM sequence: CTA
atgtaaatgacgatttaatg

SEQ ID NO: 302587 - DNA, 20 bp, Artificial Sequence
  Description of Artificial Sequence: Synthetic oligonucleotide
  Target: ATXN1; (+) strand; PAM type: YTN; PAM sequence: TTT
aatgggtgcagtacaacaac

SEQ ID NO: 302588 - DNA, 20 bp, Artificial Sequence
  Description of Artificial Sequence: Synthetic oligonucleotide
  Target: ATXN1; (+) strand; PAM type: YTN; PAM sequence: TTA
atgggtgcagtacaacaaca

SEQ ID NO: 302589 - DNA, 20 bp, Artificial Sequence
  Description of Artificial Sequence: Synthetic oligonucleotide
  Target: ATXN1; (+) strand; PAM type: YTN; PAM sequence: CTG
caagttgtgcacatctaccc

SEQ ID NO: 302590 - DNA, 20 bp, Artificial Sequence
  Description of Artificial Sequence: Synthetic oligonucleotide
  Target: ATXN1; (+) strand; PAM type: YTN; PAM sequence: TTG
tgcacatctaccctaaaact

SEQ ID NO: 302591 - DNA, 20 bp, Artificial Sequence
  Description of Artificial Sequence: Synthetic oligonucleotide
  Target: ATXN1; (+) strand; PAM type: YTN; PAM sequence: CTA
ccctaaaacttaaagtataa

SEQ ID NO: 302592 - DNA, 20 bp, Artificial Sequence
  Description of Artificial Sequence: Synthetic oligonucleotide
  Target: ATXN1; (+) strand; PAM type: YTN; PAM sequence: CTA
aaacttaaagtataatttta

SEQ ID NO: 302593 - DNA, 20 bp, Artificial Sequence
  Description of Artificial Sequence: Synthetic oligonucleotide
  Target: ATXN1; (+) strand; PAM type: YTN; PAM sequence: CTT
aaagtataattttaaaaaaa

SEQ ID NO: 302594 - DNA, 20 bp, Artificial Sequence
  Description of Artificial Sequence: Synthetic oligonucleotide
  Target: ATXN1; (+) strand; PAM type: YTN; PAM sequence: TTA
aagtataattttaaaaaaat

SEQ ID NO: 302595 - DNA, 20 bp, Artificial Sequence
  Description of Artificial Sequence: Synthetic oligonucleotide
  Target: ATXN1; (+) strand; PAM type: YTN; PAM sequence: TTT
taaaaaaattcctttataac

SEQ ID NO: 302596 - DNA, 20 bp, Artificial Sequence
  Description of Artificial Sequence: Synthetic oligonucleotide
  Target: ATXN1; (+) strand; PAM type: YTN; PAM sequence: TTT
aaaaaaattcctttataact

SEQ ID NO: 302597 - DNA, 20 bp, Artificial Sequence
  Description of Artificial Sequence: Synthetic oligonucleotide
  Target: ATXN1; (+) strand; PAM type: YTN; PAM sequence: TTA
aaaaaattcctttataactc

SEQ ID NO: 302598 - DNA, 20 bp, Artificial Sequence
  Description of Artificial Sequence: Synthetic oligonucleotide
  Target: ATXN1; (+) strand; PAM type: YTN; PAM sequence: TTC
ctttataactctatatttct

SEQ ID NO: 302599 - DNA, 20 bp, Artificial Sequence
  Description of Artificial Sequence: Synthetic oligonucleotide
  Target: ATXN1; (+) strand; PAM type: YTN; PAM sequence: CTT
tataactctatatttctctt

SEQ ID NO: 302600 - DNA, 20 bp, Artificial Sequence
  Description of Artificial Sequence: Synthetic oligonucleotide
  Target: ATXN1; (+) strand; PAM type: YTN; PAM sequence: TTT
ataactctatatttctcttt

SEQ ID NO: 302601 - DNA, 20 bp, Artificial Sequence
  Description of Artificial Sequence: Synthetic oligonucleotide
  Target: ATXN1; (+) strand; PAM type: YTN; PAM sequence: TTA
taactctatatttctcttta

SEQ ID NO: 302602 - DNA, 20 bp, Artificial Sequence
  Description of Artificial Sequence: Synthetic oligonucleotide
  Target: ATXN1; (+) strand; PAM type: YTN; PAM sequence: CTC
tatatttctctttataacct

SEQ ID NO: 302603 - DNA, 20 bp, Artificial Sequence
  Description of Artificial Sequence: Synthetic oligonucleotide
  Target: ATXN1; (+) strand; PAM type: YTN; PAM sequence: CTA
tatttctctttataacctct

SEQ ID NO: 302604 - DNA, 20 bp, Artificial Sequence
  Description of Artificial Sequence: Synthetic oligonucleotide
  Target: ATXN1; (+) strand; PAM type: YTN; PAM sequence: TTT
ctctttataacctctatgaa

SEQ ID NO: 302605 - DNA, 20 bp, Artificial Sequence
  Description of Artificial Sequence: Synthetic oligonucleotide
  Target: ATXN1; (+) strand; PAM type: YTN; PAM sequence: TTC
tctttataacctctatgaaa

SEQ ID NO: 302606 - DNA, 20 bp, Artificial Sequence
  Description of Artificial Sequence: Synthetic oligonucleotide
  Target: ATXN1; (+) strand; PAM type: YTN; PAM sequence: CTC
tttataacctctatgaaaag

SEQ ID NO: 302607 - DNA, 20 bp, Artificial Sequence
  Description of Artificial Sequence: Synthetic oligonucleotide
  Target: ATXN1; (+) strand; PAM type: YTN; PAM sequence: CTT
tataacctctatgaaaagta

SEQ ID NO: 302608 - DNA, 20 bp, Artificial Sequence
  Description of Artificial Sequence: Synthetic oligonucleotide
  Target: ATXN1; (+) strand; PAM type: YTN; PAM sequence: TTT
ataacctctatgaaaagtat

SEQ ID NO: 302609 - DNA, 20 bp, Artificial Sequence
  Description of Artificial Sequence: Synthetic oligonucleotide
  Target: ATXN1; (+) strand; PAM type: YTN; PAM sequence: TTA
taacctctatgaaaagtatt

SEQ ID NO: 302610 - DNA, 20 bp, Artificial Sequence
  Description of Artificial Sequence: Synthetic oligonucleotide
  Target: ATXN1; (+) strand; PAM type: YTN; PAM sequence: CTC
tatgaaaagtattgcaacta

SEQ ID NO: 302611 - DNA, 20 bp, Artificial Sequence
  Description of Artificial Sequence: Synthetic oligonucleotide
  Target: ATXN1; (+) strand; PAM type: YTN; PAM sequence: CTA
tgaaaagtattgcaactagg

SEQ ID NO: 302612 - DNA, 20 bp, Artificial Sequence
  Description of Artificial Sequence: Synthetic oligonucleotide
  Target: ATXN1; (+) strand; PAM type: YTN; PAM sequence: TTG
caactaggtttgaacaaaat

SEQ ID NO: 302613 - DNA, 20 bp, Artificial Sequence
  Description of Artificial Sequence: Synthetic oligonucleotide
  Target: ATXN1; (+) strand; PAM type: YTN; PAM sequence: CTA
ggtttgaacaaaatcatgta

SEQ ID NO: 302614 - DNA, 20 bp, Artificial Sequence
  Description of Artificial Sequence: Synthetic oligonucleotide
  Target: ATXN1; (+) strand; PAM type: YTN; PAM sequence: TTT
gaacaaaatcatgtaaacaa

SEQ ID NO: 302615 - DNA, 20 bp, Artificial Sequence
  Description of Artificial Sequence: Synthetic oligonucleotide
  Target: ATXN1; (+) strand; PAM type: YTN; PAM sequence: TTG
aacaaaatcatgtaaacaaa

SEQ ID NO: 302616 - DNA, 20 bp, Artificial Sequence
  Description of Artificial Sequence: Synthetic oligonucleotide
  Target: ATXN1; (+) strand; PAM type: YTN; PAM sequence: CTT
ggagactaacatcttaattt

SEQ ID NO: 302617 - DNA, 20 bp, Artificial Sequence
  Description of Artificial Sequence: Synthetic oligonucleotide
  Target: ATXN1; (+) strand; PAM type: YTN; PAM sequence: TTG
gagactaacatcttaatttt

SEQ ID NO: 302618 - DNA, 20 bp, Artificial Sequence
  Description of Artificial Sequence: Synthetic oligonucleotide
  Target: ATXN1; (+) strand; PAM type: YTN; PAM sequence: CTA
acatcttaattttaacaatg

SEQ ID NO: 302619 - DNA, 20 bp, Artificial Sequence
  Description of Artificial Sequence: Synthetic oligonucleotide
  Target: ATXN1; (+) strand; PAM type: YTN; PAM sequence: CTT
aattttaacaatgactatac

SEQ ID NO: 302620 - DNA, 20 bp, Artificial Sequence
  Description of Artificial Sequence: Synthetic oligonucleotide
  Target: ATXN1; (+) strand; PAM type: YTN; PAM sequence: TTA
attttaacaatgactatact

SEQ ID NO: 302621 - DNA, 20 bp, Artificial Sequence
  Description of Artificial Sequence: Synthetic oligonucleotide
  Target: ATXN1; (+) strand; PAM type: YTN; PAM sequence: TTT
taacaatgactatactgggc

SEQ ID NO: 302622 - DNA, 20 bp, Artificial Sequence
  Description of Artificial Sequence: Synthetic oligonucleotide
  Target: ATXN1; (+) strand; PAM type: YTN; PAM sequence: TTT
aacaatgactatactgggct

SEQ ID NO: 302623 - DNA, 20 bp, Artificial Sequence
  Description of Artificial Sequence: Synthetic oligonucleotide
  Target: ATXN1; (+) strand; PAM type: YTN; PAM sequence: TTA
acaatgactatactgggctg

SEQ ID NO: 302624 - DNA, 20 bp, Artificial Sequence
  Description of Artificial Sequence: Synthetic oligonucleotide
  Target: ATXN1; (+) strand; PAM type: YTN; PAM sequence: CTA
tactgggctgtgggggtaaa

SEQ ID NO: 302625 - DNA, 20 bp, Artificial Sequence
  Description of Artificial Sequence: Synthetic oligonucleotide
  Target: ATXN1; (+) strand; PAM type: YTN; PAM sequence: CTG
ggctgtgggggtaaatgttt

SEQ ID NO: 302626 - DNA, 20 bp, Artificial Sequence
  Description of Artificial Sequence: Synthetic oligonucleotide
  Target: ATXN1; (+) strand; PAM type: YTN; PAM sequence: CTG
tgggggtaaatgtttccttt

SEQ ID NO: 302627 - DNA, 20 bp, Artificial Sequence
  Description of Artificial Sequence: Synthetic oligonucleotide
  Target: ATXN1; (+) strand; PAM type: YTN; PAM sequence: TTT
cctttctttactcagtttag

SEQ ID NO: 302628 - DNA, 20 bp, Artificial Sequence
  Description of Artificial Sequence: Synthetic oligonucleotide
  Target: ATXN1; (+) strand; PAM type: YTN; PAM sequence: TTC
ctttctttactcagtttagg

SEQ ID NO: 302629 - DNA, 20 bp, Artificial Sequence
  Description of Artificial Sequence: Synthetic oligonucleotide
  Target: ATXN1; (+) strand; PAM type: YTN; PAM sequence: CTT
tctttactcagtttaggaaa

SEQ ID NO: 302630 - DNA, 20 bp, Artificial Sequence
  Description of Artificial Sequence: Synthetic oligonucleotide
  Target: ATXN1; (+) strand; PAM type: YTN; PAM sequence: TTT
ctttactcagtttaggaaac

SEQ ID NO: 302631 - DNA, 20 bp, Artificial Sequence
  Description of Artificial Sequence: Synthetic oligonucleotide
  Target: ATXN1; (+) strand; PAM type: YTN; PAM sequence: TTC
tttactcagtttaggaaact

SEQ ID NO: 302632 - DNA, 20 bp, Artificial Sequence
  Description of Artificial Sequence: Synthetic oligonucleotide
  Target: ATXN1; (+) strand; PAM type: YTN; PAM sequence: CTT
tactcagtttaggaaactgt

SEQ ID NO: 302633 - DNA, 20 bp, Artificial Sequence
  Description of Artificial Sequence: Synthetic oligonucleotide
  Target: ATXN1; (+) strand; PAM type: YTN; PAM sequence: TTT
actcagtttaggaaactgtg

SEQ ID NO: 302634 - DNA, 20 bp, Artificial Sequence
  Description of Artificial Sequence: Synthetic oligonucleotide
  Target: ATXN1; (+) strand; PAM type: YTN; PAM sequence: TTA
ctcagtttaggaaactgtgc

SEQ ID NO: 302635 - DNA, 20 bp, Artificial Sequence
  Description of Artificial Sequence: Synthetic oligonucleotide
  Target: ATXN1; (+) strand; PAM type: YTN; PAM sequence: CTC
agtttaggaaactgtgccta

SEQ ID NO: 302636 - DNA, 20 bp, Artificial Sequence
  Description of Artificial Sequence: Synthetic oligonucleotide
  Target: ATXN1; (+) strand; PAM type: YTN; PAM sequence: TTT
aggaaactgtgcctataata

SEQ ID NO: 302637 - DNA, 20 bp, Artificial Sequence
  Description of Artificial Sequence: Synthetic oligonucleotide
  Target: ATXN1; (+) strand; PAM type: YTN; PAM sequence: TTA
ggaaactgtgcctataataa

SEQ ID NO: 302638 - DNA, 20 bp, Artificial Sequence
  Description of Artificial Sequence: Synthetic oligonucleotide
  Target: ATXN1; (+) strand; PAM type: YTN; PAM sequence: CTG
tgcctataataaatagtaca

SEQ ID NO: 302639 - DNA, 20 bp, Artificial Sequence
  Description of Artificial Sequence: Synthetic oligonucleotide
  Target: ATXN1; (+) strand; PAM type: YTN; PAM sequence: CTA
taataaatagtacatctatg

SEQ ID NO: 302640 - DNA, 20 bp, Artificial Sequence
  Description of Artificial Sequence: Synthetic oligonucleotide
  Target: ATXN1; (+) strand; PAM type: YTN; PAM sequence: CTA
tggtgaatgtacttaatgcc

SEQ ID NO: 302641 - DNA, 20 bp, Artificial Sequence
  Description of Artificial Sequence: Synthetic oligonucleotide
  Target: ATXN1; (+) strand; PAM type: YTN; PAM sequence: CTT
aatgccactgaaatgcatat

SEQ ID NO: 302642 - DNA, 20 bp, Artificial Sequence
  Description of Artificial Sequence: Synthetic oligonucleotide
  Target: ATXN1; (+) strand; PAM type: YTN; PAM sequence: TTA
atgccactgaaatgcatatt

SEQ ID NO: 302643 - DNA, 20 bp, Artificial Sequence
  Description of Artificial Sequence: Synthetic oligonucleotide
  Target: ATXN1; (+) strand; PAM type: YTN; PAM sequence: CTG
aaatgcatatttaaaaatgg

SEQ ID NO: 302644 - DNA, 20 bp, Artificial Sequence
  Description of Artificial Sequence: Synthetic oligonucleotide
  Target: ATXN1; (+) strand; PAM type: YTN; PAM sequence: TTT
aaaaatggttaaagtgggtt

SEQ ID NO: 302645 - DNA, 20 bp, Artificial Sequence
  Description of Artificial Sequence: Synthetic oligonucleotide
  Target: ATXN1; (+) strand; PAM type: YTN; PAM sequence: TTA
aaaatggttaaagtgggttg

SEQ ID NO: 302646 - DNA, 20 bp, Artificial Sequence
  Description of Artificial Sequence: Synthetic oligonucleotide
  Target: ATXN1; (+) strand; PAM type: YTN; PAM sequence: TTA
aagtgggttgggcacagtgg

SEQ ID NO: 302647 - DNA, 20 bp, Artificial Sequence
  Description of Artificial Sequence: Synthetic oligonucleotide
  Target: ATXN1; (+) strand; PAM type: YTN; PAM sequence: TTG
ggcacagtggctcacgactg

SEQ ID NO: 302648 - DNA, 20 bp, Artificial Sequence
  Description of Artificial Sequence: Synthetic oligonucleotide
  Target: ATXN1; (+) strand; PAM type: YTN; PAM sequence: CTC
acgactgtaatcccggcact

SEQ ID NO: 302649 - DNA, 20 bp, Artificial Sequence
  Description of Artificial Sequence: Synthetic oligonucleotide
  Target: ATXN1; (+) strand; PAM type: YTN; PAM sequence: CTG
taatcccggcactttgggag

SEQ ID NO: 302650 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggtgg

SEQ ID NO: 302651 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggtgga

SEQ ID NO: 302652 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggtggat

SEQ ID NO: 302653 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcgagacca

SEQ ID NO: 302654 - DNA, 20 bp, Artificial Sequence
  Description of Artificial Sequence: Synthetic oligonucleotide
  Target: ATXN1; (+) strand; PAM type: YTN; PAM sequence: TTC
gagaccaatctggccaacat

SEQ ID NO: 302655 - DNA, 20 bp, Artificial Sequence
  Description of Artificial Sequence: Synthetic oligonucleotide
  Target: ATXN1; (+) strand; PAM type: YTN; PAM sequence: CTG
gccaacatagtgaaaccccg

SEQ ID NO: 302656 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaactag

SEQ ID NO: 302657 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaactagct

SEQ ID NO: 302658 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaactagctggg

SEQ ID NO: 302659 - DNA, 20 bp, Artificial Sequence
  Description of Artificial Sequence: Synthetic oligonucleotide
  Target: ATXN1; (+) strand; PAM type: YTN; PAM sequence: CTA
gctgggtgtgatggcgcacg

SEQ ID NO: 302660 - DNA, 20 bp, Artificial Sequence
  Description of Artificial Sequence: Synthetic oligonucleotide
  Target: ATXN1; (+) strand; PAM type: YTN; PAM sequence: CTG
ggtgtgatggcgcacgcctg

SEQ ID NO: 302661 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacccgggag

SEQ ID NO: 302662 - DNA, 20 bp, Artificial Sequence
  Description of Artificial Sequence: Synthetic oligonucleotide
  Target: ATXN1; (+) strand; PAM type: YTN; PAM sequence: CTA
cccgggagcctgagccagga

SEQ ID NO: 302663 - DNA, 20 bp, Artificial Sequence
  Description of Artificial Sequence: Synthetic oligonucleotide
  Target: ATXN1; (+) strand; PAM type: YTN; PAM sequence: CTG
agccaggagaattgcttgaa

SEQ ID NO: 302664 - DNA, 20 bp, Artificial Sequence
  Description of Artificial Sequence: Synthetic oligonucleotide
  Target: ATXN1; (+) strand; PAM type: YTN; PAM sequence: TTG
cttgaacctggggggtggag

SEQ ID NO: 302665 - DNA, 20 bp, Artificial Sequence
  Description of Artificial Sequence: Synthetic oligonucleotide
  Target: ATXN1; (+) strand; PAM type: YTN; PAM sequence: CTT
gaacctggggggtggaggtt

SEQ ID NO: 302666 - DNA, 20 bp, Artificial Sequence
  Description of Artificial Sequence: Synthetic oligonucleotide
  Target: ATXN1; (+) strand; PAM type: YTN; PAM sequence: TTG
aacctggggggtggaggttg

SEQ ID NO: 302667 - DNA, 20 bp, Artificial Sequence
  Description of Artificial Sequence: Synthetic oligonucleotide
  Target: ATXN1; (+) strand; PAM type: YTN; PAM sequence: CTG
gggggtggaggttgcagtga

SEQ ID NO: 302668 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatcacacc

SEQ ID NO: 302669 - DNA, 20 bp, Artificial Sequence
  Description of Artificial Sequence: Synthetic oligonucleotide
  Target: ATXN1; (+) strand; PAM type: YTN; PAM sequence: CTG
agatcacaccactgcactcc

SEQ ID NO: 302670 - DNA, 20 bp, Artificial Sequence
  Description of Artificial Sequence: Synthetic oligonucleotide
  Target: ATXN1; (+) strand; PAM type: YTN; PAM sequence: CTG
cactccagtgcaggcaacaa

SEQ ID NO: 302671 - DNA, 20 bp, Artificial Sequence
  Description of Artificial Sequence: Synthetic oligonucleotide
  Target: ATXN1; (+) strand; PAM type: YTN; PAM sequence: CTC
cagtgcaggcaacaagagcg

SEQ ID NO: 302672 - DNA, 20 bp, Artificial Sequence
  Description of Artificial Sequence: Synthetic oligonucleotide
  Target: ATXN1; (+) strand; PAM type: YTN; PAM sequence: TTC
catctcaaaaaaacaaagca

SEQ ID NO: 302673 - DNA, 20 bp, Artificial Sequence
  Description of Artificial Sequence: Synthetic oligonucleotide
  Target: ATXN1; (+) strand; PAM type: YTN; PAM sequence: CTC
aaaaaaacaaagcaataaca

SEQ ID NO: 302674 - DNA, 20 bp, Artificial Sequence
  Description of Artificial Sequence: Synthetic oligonucleotide
  Target: ATXN1; (+) strand; PAM type: YTN; PAM sequence: TTA
aagcagcagcttttatgttg

SEQ ID NO: 302675 - DNA, 20 bp, Artificial Sequence
  Description of Artificial Sequence: Synthetic oligonucleotide
  Target: ATXN1; (+) strand; PAM type: YTN; PAM sequence: CTT
ttatgttgagtgtctctaac

SEQ ID NO: 302676 - DNA, 20 bp, Artificial Sequence
  Description of Artificial Sequence: Synthetic oligonucleotide
  Target: ATXN1; (+) strand; PAM type: YTN; PAM sequence: TTT
tatgttgagtgtctctaact

SEQ ID NO: 302677 - DNA, 20 bp, Artificial Sequence
  Description of Artificial Sequence: Synthetic oligonucleotide
  Target: ATXN1; (+) strand; PAM type: YTN; PAM sequence: TTT
atgttgagtgtctctaacta

SEQ ID NO: 302678 - DNA, 20 bp, Artificial Sequence
  Description of Artificial Sequence: Synthetic oligonucleotide
  Target: ATXN1; (+) strand; PAM type: YTN; PAM sequence: TTA
tgttgagtgtctctaactac

SEQ ID NO: 302679 - DNA, 20 bp, Artificial Sequence
  Description of Artificial Sequence: Synthetic oligonucleotide
  Target: ATXN1; (+) strand; PAM type: YTN; PAM sequence: TTG
agtgtctctaactaccattt

SEQ ID NO: 302680 - DNA, 20 bp, Artificial Sequence
  Description of Artificial Sequence: Synthetic oligonucleotide
  Target: ATXN1; (+) strand; PAM type: YTN; PAM sequence: CTC
taactaccatttaaaaactt

SEQ ID NO: 302681 - DNA, 20 bp, Artificial Sequence
  Description of Artificial Sequence: Synthetic oligonucleotide
  Target: ATXN1; (+) strand; PAM type: YTN; PAM sequence: CTA
actaccatttaaaaacttaa

SEQ ID NO: 302682 - DNA, 20 bp, Artificial Sequence
  Description of Artificial Sequence: Synthetic oligonucleotide
  Target: ATXN1; (+) strand; PAM type: YTN; PAM sequence: CTA
ccatttaaaaacttaaatct

SEQ ID NO: 302683 - DNA, 20 bp, Artificial Sequence
  Description of Artificial Sequence: Synthetic oligonucleotide
  Target: ATXN1; (+) strand; PAM type: YTN; PAM sequence: TTT
aaaaacttaaatctgtataa

SEQ ID NO: 302684 - DNA, 20 bp, Artificial Sequence
  Description of Artificial Sequence: Synthetic oligonucleotide
  Target: ATXN1; (+) strand; PAM type: YTN; PAM sequence: TTA
aaaacttaaatctgtataag

SEQ ID NO: 302685 - DNA, 20 bp, Artificial Sequence
  Description of Artificial Sequence: Synthetic oligonucleotide
  Target: ATXN1; (+) strand; PAM type: YTN; PAM sequence: CTT
aaatctgtataagagagcag

SEQ ID NO: 302686 - DNA, 20 bp, Artificial Sequence
  Description of Artificial Sequence: Synthetic oligonucleotide
  Target: ATXN1; (+) strand; PAM type: YTN; PAM sequence: TTA
aatctgtataagagagcagg

SEQ ID NO: 302687 - DNA, 20 bp, Artificial Sequence
  Description of Artificial Sequence: Synthetic oligonucleotide
  Target: ATXN1; (+) strand; PAM type: YTN; PAM sequence: CTG
tataagagagcaggcaaaac

SEQ ID NO: 302688 - DNA, 20 bp, Artificial Sequence
  Description of Artificial Sequence: Synthetic oligonucleotide
  Target: ATXN1; (+) strand; PAM type: YTN; PAM sequence: CTG
tacgaatgttttggaggtgc

SEQ ID NO: 302689 - DNA, 20 bp, Artificial Sequence
  Description of Artificial Sequence: Synthetic oligonucleotide
  Target: ATXN1; (+) strand; PAM type: YTN; PAM sequence: TTT
tggaggtgcgcactgagtta

SEQ ID NO: 302690 - DNA, 20 bp, Artificial Sequence
  Description of Artificial Sequence: Synthetic oligonucleotide
  Target: ATXN1; (+) strand; PAM type: YTN; PAM sequence: TTT
ggaggtgcgcactgagttaa

SEQ ID NO: 302691 - DNA, 20 bp, Artificial Sequence
  Description of Artificial Sequence: Synthetic oligonucleotide
  Target: ATXN1; (+) strand; PAM type: YTN; PAM sequence: TTG
gaggtgcgcactgagttaaa

SEQ ID NO: 302692 - DNA, 20 bp, Artificial Sequence
  Description of Artificial Sequence: Synthetic oligonucleotide
  Target: ATXN1; (+) strand; PAM type: YTN; PAM sequence: CTG
agttaaaaataaaaaacatg

SEQ ID NO: 302693 - DNA, 20 bp, Artificial Sequence
  Description of Artificial Sequence: Synthetic oligonucleotide
  Target: ATXN1; (+) strand; PAM type: YTN; PAM sequence: TTA
aaaataaaaaacatggaatt

SEQ ID NO: 302694 - DNA, 20 bp, Artificial Sequence
  Description of Artificial Sequence: Synthetic oligonucleotide
  Target: ATXN1; (+) strand; PAM type: YTN; PAM sequence: TTT
attttcatttcctatctaat

SEQ ID NO: 302695 - DNA, 20 bp, Artificial Sequence
  Description of Artificial Sequence: Synthetic oligonucleotide
  Target: ATXN1; (+) strand; PAM type: YTN; PAM sequence: TTA
ttttcatttcctatctaatt

SEQ ID NO: 302696 - DNA, 20 bp, Artificial Sequence
  Description of Artificial Sequence: Synthetic oligonucleotide
  Target: ATXN1; (+) strand; PAM type: YTN; PAM sequence: TTT
tcatttcctatctaatttgg

SEQ ID NO: 302697 - DNA, 20 bp, Artificial Sequence
  Description of Artificial Sequence: Synthetic oligonucleotide
  Target: ATXN1; (+) strand; PAM type: YTN; PAM sequence: TTT
catttcctatctaatttggt

SEQ ID NO: 302698 - DNA, 20 bp, Artificial Sequence
  Description of Artificial Sequence: Synthetic oligonucleotide
  Target: ATXN1; (+) strand; PAM type: YTN; PAM sequence: TTC
atttcctatctaatttggtc

SEQ ID NO: 302699 - DNA, 20 bp, Artificial Sequence
  Description of Artificial Sequence: Synthetic oligonucleotide
  Target: ATXN1; (+) strand; PAM type: YTN; PAM sequence: TTT
cctatctaatttggtctcca

SEQ ID NO: 302700 - DNA, 20 bp, Artificial Sequence
  Description of Artificial Sequence: Synthetic oligonucleotide
  Target: ATXN1; (+) strand; PAM type: YTN; PAM sequence: TTC
ctatctaatttggtctccag

SEQ ID NO: 302701 - DNA, 20 bp, Artificial Sequence
  Description of Artificial Sequence: Synthetic oligonucleotide
  Target: ATXN1; (+) strand; PAM type: YTN; PAM sequence: CTA
tctaatttggtctccagagc

SEQ ID NO: 302702 - DNA, 20 bp, Artificial Sequence
  Description of Artificial Sequence: Synthetic oligonucleotide
  Target: ATXN1; (+) strand; PAM type: YTN; PAM sequence: CTA
atttggtctccagagcctgc

SEQ ID NO: 302703 - DNA, 20 bp, Artificial Sequence
  Description of Artificial Sequence: Synthetic oligonucleotide
  Target: ATXN1; (+) strand; PAM type: YTN; PAM sequence: TTT
ggtctccagagcctgctaag

SEQ ID NO: 302704 - DNA, 20 bp, Artificial Sequence
  Description of Artificial Sequence: Synthetic oligonucleotide
  Target: ATXN1; (+) strand; PAM type: YTN; PAM sequence: TTG
gtctccagagcctgctaagt

SEQ ID NO: 302705 - DNA, 20 bp, Artificial Sequence
  Description of Artificial Sequence: Synthetic oligonucleotide
  Target: ATXN1; (+) strand; PAM type: YTN; PAM sequence: CTC
cagagcctgctaagtacagt

SEQ ID NO: 302706 - DNA, 20 bp, Artificial Sequence
  Description of Artificial Sequence: Synthetic oligonucleotide
  Target: ATXN1; (+) strand; PAM type: YTN; PAM sequence: CTG
ctaagtacagtttccatttc

SEQ ID NO: 302707 - DNA, 20 bp, Artificial Sequence
  Description of Artificial Sequence: Synthetic oligonucleotide
  Target: ATXN1; (+) strand; PAM type: YTN; PAM sequence: CTA
agtacagtttccatttctac

SEQ ID NO: 302708 - DNA, 20 bp, Artificial Sequence
  Description of Artificial Sequence: Synthetic oligonucleotide
  Target: ATXN1; (+) strand; PAM type: YTN; PAM sequence: TTT
ccatttctactcgggtgcaa

SEQ ID NO: 302709 - DNA, 20 bp, Artificial Sequence
  Description of Artificial Sequence: Synthetic oligonucleotide
  Target: ATXN1; (+) strand; PAM type: YTN; PAM sequence: TTC
catttctactcgggtgcaag

SEQ ID NO: 302710 - DNA, 20 bp, Artificial Sequence
  Description of Artificial Sequence: Synthetic oligonucleotide
  Target: ATXN1; (+) strand; PAM type: YTN; PAM sequence: TTT
ctactcgggtgcaagagcaa

SEQ ID NO: 302711 - DNA, 20 bp, Artificial Sequence
  Description of Artificial Sequence: Synthetic oligonucleotide
  Target: ATXN1; (+) strand; PAM type: YTN; PAM sequence: TTC
tactcgggtgcaagagcaat

SEQ ID NO: 302712 - DNA, 20 bp, Artificial Sequence
  Description of Artificial Sequence: Synthetic oligonucleotide
  Target: ATXN1; (+) strand; PAM type: YTN; PAM sequence: CTA
ctcgggtgcaagagcaatgg

SEQ ID NO: 302713 - DNA, 20 bp, Artificial Sequence
  Description of Artificial Sequence: Synthetic oligonucleotide
  Target: ATXN1; (+) strand; PAM type: YTN; PAM sequence: CTC
gggtgcaagagcaatggctt

SEQ ID NO: 302714 - DNA, 20 bp, Artificial Sequence
  Description of Artificial Sequence: Synthetic oligonucleotide
  Target: ATXN1; (+) strand; PAM type: YTN; PAM sequence: CTT
atttgctgttttacggagca

SEQ ID NO: 302715 - DNA, 20 bp, Artificial Sequence
  Description of Artificial Sequence: Synthetic oligonucleotide
  Target: ATXN1; (+) strand; PAM type: YTN; PAM sequence: TTA
tttgctgttttacggagcag

SEQ ID NO: 302716 - DNA, 20 bp, Artificial Sequence
  Description of Artificial Sequence: Synthetic oligonucleotide
  Target: ATXN1; (+) strand; PAM type: YTN; PAM sequence: TTT
gctgttttacggagcagttc

SEQ ID NO: 302717 - DNA, 20 bp, Artificial Sequence
  Description of Artificial Sequence: Synthetic oligonucleotide
  Target: ATXN1; (+) strand; PAM type: YTN; PAM sequence: TTG
ctgttttacggagcagttcc

SEQ ID NO: 302718 - DNA, 20 bp, Artificial Sequence
  Description of Artificial Sequence: Synthetic oligonucleotide
  Target: ATXN1; (+) strand; PAM type: YTN; PAM sequence: CTG
ttttacggagcagttcctta

SEQ ID NO: 302719 - DNA, 20 bp, Artificial Sequence
  Description of Artificial Sequence: Synthetic oligonucleotide
  Target: ATXN1; (+) strand; PAM type: YTN; PAM sequence: TTT
tacggagcagttccttaact

SEQ ID NO: 302720 - DNA, 20 bp, Artificial Sequence
  Description of Artificial Sequence: Synthetic oligonucleotide
  Target: ATXN1; (+) strand; PAM type: YTN; PAM sequence: TTT
acggagcagttccttaacta

SEQ ID NO: 302721 - DNA, 20 bp, Artificial Sequence
  Description of Artificial Sequence: Synthetic oligonucleotide
  Target: ATXN1; (+) strand; PAM type: YTN; PAM sequence: TTA
cggagcagttccttaactat

SEQ ID NO: 302722 - DNA, 20 bp, Artificial Sequence
  Description of Artificial Sequence: Synthetic oligonucleotide
  Target: ATXN1; (+) strand; PAM type: YTN; PAM sequence: TTC
cttaactatcattgcctctg

SEQ ID NO: 302723 - DNA, 20 bp, Artificial Sequence
  Description of Artificial Sequence: Synthetic oligonucleotide
  Target: ATXN1; (+) strand; PAM type: YTN; PAM sequence: CTT
aactatcattgcctctgaac

SEQ ID NO: 302724 - DNA, 20 bp, Artificial Sequence
  Description of Artificial Sequence: Synthetic oligonucleotide
  Target: ATXN1; (+) strand; PAM type: YTN; PAM sequence: TTA
actatcattgcctctgaacc

SEQ ID NO: 302725 - DNA, 20 bp, Artificial Sequence
  Description of Artificial Sequence: Synthetic oligonucleotide
  Target: ATXN1; (+) strand; PAM type: YTN; PAM sequence: CTA
tcattgcctctgaaccccct

SEQ ID NO: 302726 - DNA, 20 bp, Artificial Sequence
  Description of Artificial Sequence: Synthetic oligonucleotide
  Target: ATXN1; (+) strand; PAM type: YTN; PAM sequence: TTG
cctctgaaccccctttcccc

SEQ ID NO: 302727 - DNA, 20 bp, Artificial Sequence
  Description of Artificial Sequence: Synthetic oligonucleotide
  Target: ATXN1; (+) strand; PAM type: YTN; PAM sequence: CTC
tgaaccccctttccccccaa

SEQ ID NO: 302728 - DNA, 20 bp, Artificial Sequence
  Description of Artificial Sequence: Synthetic oligonucleotide
  Target: ATXN1; (+) strand; PAM type: YTN; PAM sequence: CTG
aaccccctttccccccaaga

SEQ ID NO: 302729 - DNA, 20 bp, Artificial Sequence
  Description of Artificial Sequence: Synthetic oligonucleotide
  Target: ATXN1; (+) strand; PAM type: YTN; PAM sequence: CTT
tccccccaagattgactgtc

SEQ ID NO: 302730 - DNA, 20 bp, Artificial Sequence
  Description of Artificial Sequence: Synthetic oligonucleotide
  Target: ATXN1; (+) strand; PAM type: YTN; PAM sequence: TTT
ccccccaagattgactgtcg

SEQ ID NO: 302731 - DNA, 20 bp, Artificial Sequence
  Description of Artificial Sequence: Synthetic oligonucleotide
  Target: ATXN1; (+) strand; PAM type: YTN; PAM sequence: TTC
cccccaagattgactgtcgg

SEQ ID NO: 302732 - DNA, 20 bp, Artificial Sequence
  Description of Artificial Sequence: Synthetic oligonucleotide
  Target: ATXN1; (+) strand; PAM type: YTN; PAM sequence: TTG
actgtcggtctacagaatca

SEQ ID NO: 302733 - DNA, 20 bp, Artificial Sequence
  Description of Artificial Sequence: Synthetic oligonucleotide
  Target: ATXN1; (+) strand; PAM type: YTN; PAM sequence: CTG
tcggtctacagaatcagtta

SEQ ID NO: 302734 - DNA, 20 bp, Artificial Sequence
  Description of Artificial Sequence: Synthetic oligonucleotide
  Target: ATXN1; (+) strand; PAM type: YTN; PAM sequence: CTA
cagaatcagttaagtgctac

SEQ ID NO: 302735 - DNA, 20 bp, Artificial Sequence
  Description of Artificial Sequence: Synthetic oligonucleotide
  Target: ATXN1; (+) strand; PAM type: YTN; PAM sequence: TTA
agtgctacaaatcactacta

SEQ ID NO: 302736 - DNA, 20 bp, Artificial Sequence
  Description of Artificial Sequence: Synthetic oligonucleotide
  Target: ATXN1; (+) strand; PAM type: YTN; PAM sequence: CTA
caaatcactactaacagctc

SEQ ID NO: 302737 - DNA, 20 bp, Artificial Sequence
  Description of Artificial Sequence: Synthetic oligonucleotide
  Target: ATXN1; (+) strand; PAM type: YTN; PAM sequence: CTA
ctaacagctcctgcgaggcg

SEQ ID NO: 302738 - DNA, 20 bp, Artificial Sequence
  Description of Artificial Sequence: Synthetic oligonucleotide
  Target: ATXN1; (+) strand; PAM type: YTN; PAM sequence: CTA
acagctcctgcgaggcgctc

SEQ ID NO: 302739 - DNA, 20 bp, Artificial Sequence
  Description of Artificial Sequence: Synthetic oligonucleotide
  Target: ATXN1; (+) strand; PAM type: YTN; PAM sequence: CTC
ctgcgaggcgctccctctaa

SEQ ID NO: 302740 - DNA, 20 bp, Artificial Sequence
  Description of Artificial Sequence: Synthetic oligonucleotide
  Target: ATXN1; (+) strand; PAM type: YTN; PAM sequence: CTG
cgaggcgctccctctaagaa

SEQ ID NO: 302741 - DNA, 20 bp, Artificial Sequence
  Description of Artificial Sequence: Synthetic oligonucleotide
  Target: ATXN1; (+) strand; PAM type: YTN; PAM sequence: CTC
cctctaagaatctgtacaga

SEQ ID NO: 302742 - DNA, 20 bp, Artificial Sequence
  Description of Artificial Sequence: Synthetic oligonucleotide
  Target: ATXN1; (+) strand; PAM type: YTN; PAM sequence: CTC
taagaatctgtacagatcaa

SEQ ID NO: 302743 - DNA, 20 bp, Artificial Sequence
  Description of Artificial Sequence: Synthetic oligonucleotide
  Target: ATXN1; (+) strand; PAM type: YTN; PAM sequence: CTA
agaatctgtacagatcaaaa

SEQ ID NO: 302744 - DNA, 20 bp, Artificial Sequence
  Description of Artificial Sequence: Synthetic oligonucleotide
  Target: ATXN1; (+) strand; PAM type: YTN; PAM sequence: CTG
tacagatcaaaatctcaagt

SEQ ID NO: 302745 - DNA, 20 bp, Artificial Sequence
  Description of Artificial Sequence: Synthetic oligonucleotide
  Target: ATXN1; (+) strand; PAM type: YTN; PAM sequence: CTC
aagtgcttacttgcccaggg

SEQ ID NO: 302746 - DNA, 20 bp, Artificial Sequence
  Description of Artificial Sequence: Synthetic oligonucleotide
  Target: ATXN1; (+) strand; PAM type: YTN; PAM sequence: CTT
acttgcccagggactgccat

SEQ ID NO: 302747 - DNA, 20 bp, Artificial Sequence
  Description of Artificial Sequence: Synthetic oligonucleotide
  Target: ATXN1; (+) strand; PAM type: YTN; PAM sequence: TTA
cttgcccagggactgccata

SEQ ID NO: 302748 - DNA, 20 bp, Artificial Sequence
  Description of Artificial Sequence: Synthetic oligonucleotide
  Target: ATXN1; (+) strand; PAM type: YTN; PAM sequence: CTT
gcccagggactgccataatt

SEQ ID NO: 302749 - DNA, 20 bp, Artificial Sequence
  Description of Artificial Sequence: Synthetic oligonucleotide
  Target: ATXN1; (+) strand; PAM type: YTN; PAM sequence: TTG
cccagggactgccataattt

SEQ ID NO: 302750 - DNA, 20 bp, Artificial Sequence
  Description of Artificial Sequence: Synthetic oligonucleotide
  Target: ATXN1; (+) strand; PAM type: YTN; PAM sequence: CTG
ccataatttgaggtgttgct

SEQ ID NO: 302751 - DNA, 20 bp, Artificial Sequence
  Description of Artificial Sequence: Synthetic oligonucleotide
  Target: ATXN1; (+) strand; PAM type: YTN; PAM sequence: TTT
gaggtgttgcttctttttaa

SEQ ID NO: 302752 - DNA, 20 bp, Artificial Sequence
  Description of Artificial Sequence: Synthetic oligonucleotide
  Target: ATXN1; (+) strand; PAM type: YTN; PAM sequence: TTG
aggtgttgcttctttttaaa

SEQ ID NO: 302753 - DNA, 20 bp, Artificial Sequence
  Description of Artificial Sequence: Synthetic oligonucleotide
  Target: ATXN1; (+) strand; PAM type: YTN; PAM sequence: TTG
cttctttttaaagtataaaa

SEQ ID NO: 302754 - DNA, 20 bp, Artificial Sequence
  Description of Artificial Sequence: Synthetic oligonucleotide
  Target: ATXN1; (+) strand; PAM type: YTN; PAM sequence: CTT
ctttttaaagtataaaaaac

SEQ ID NO: 302755 - DNA, 20 bp, Artificial Sequence
  Description of Artificial Sequence: Synthetic oligonucleotide
  Target: ATXN1; (+) strand; PAM type: YTN; PAM sequence: TTC
tttttaaagtataaaaaaca

SEQ ID NO: 302756 - DNA, 20 bp, Artificial Sequence
  Description of Artificial Sequence: Synthetic oligonucleotide
  Target: ATXN1; (+) strand; PAM type: YTN; PAM sequence: CTT
tttaaagtataaaaaacaga

SEQ ID NO: 302757 - DNA, 20 bp, Artificial Sequence
  Description of Artificial Sequence: Synthetic oligonucleotide
  Target: ATXN1; (+) strand; PAM type: YTN; PAM sequence: TTT
ttaaagtataaaaaacagat

SEQ ID NO: 302758 - DNA, 20 bp, Artificial Sequence
  Description of Artificial Sequence: Synthetic oligonucleotide
  Target: ATXN1; (+) strand; PAM type: YTN; PAM sequence: TTT
taaagtataaaaaacagatg

SEQ ID NO: 302759 - DNA, 20 bp, Artificial Sequence
  Description of Artificial Sequence: Synthetic oligonucleotide
  Target: ATXN1; (+) strand; PAM type: YTN; PAM sequence: TTT
aaagtataaaaaacagatgc

SEQ ID NO: 302760 - DNA, 20 bp, Artificial Sequence
  Description of Artificial Sequence: Synthetic oligonucleotide
  Target: ATXN1; (+) strand; PAM type: YTN; PAM sequence: TTA
aagtataaaaaacagatgct

SEQ ID NO: 302761 - DNA, 20 bp, Artificial Sequence
  Description of Artificial Sequence: Synthetic oligonucleotide
  Target: ATXN1; (+) strand; PAM type: YTN; PAM sequence: CTC
taagctgatgaaagtaaatg

SEQ ID NO: 302762 - DNA, 20 bp, Artificial Sequence
  Description of Artificial Sequence: Synthetic oligonucleotide
  Target: ATXN1; (+) strand; PAM type: YTN; PAM sequence: CTA
agctgatgaaagtaaatgtc

SEQ ID NO: 302763 - DNA, 20 bp, Artificial Sequence
  Description of Artificial Sequence: Synthetic oligonucleotide
  Target: ATXN1; (+) strand; PAM type: YTN; PAM sequence: CTG
atgaaagtaaatgtcctttc

SEQ ID NO: 302764 - DNA, 20 bp, Artificial Sequence
  Description of Artificial Sequence: Synthetic oligonucleotide
  Target: ATXN1; (+) strand; PAM type: YTN; PAM sequence: CTT
tcaacacatctcttccccag

SEQ ID NO: 302765 - DNA, 20 bp, Artificial Sequence
  Description of Artificial Sequence: Synthetic oligonucleotide
  Target: ATXN1; (+) strand; PAM type: YTN; PAM sequence: TTT
caacacatctcttccccagc

SEQ ID NO: 302766 - DNA, 20 bp, Artificial Sequence
  Description of Artificial Sequence: Synthetic oligonucleotide
  Target: ATXN1; (+) strand; PAM type: YTN; PAM sequence: TTC
aacacatctcttccccagca

SEQ ID NO: 302767 - DNA, 20 bp, Artificial Sequence
  Description of Artificial Sequence: Synthetic oligonucleotide
  Target: ATXN1; (+) strand; PAM type: YTN; PAM sequence: CTC
ttccccagcacttgaaaatc

SEQ ID NO: 302768 - DNA, 20 bp, Artificial Sequence
  Description of Artificial Sequence: Synthetic oligonucleotide
  Target: ATXN1; (+) strand; PAM type: YTN; PAM sequence: CTT
ccccagcacttgaaaatctt

SEQ ID NO: 302769 - DNA, 20 bp, Artificial Sequence
  Description of Artificial Sequence: Synthetic oligonucleotide
  Target: ATXN1; (+) strand; PAM type: YTN; PAM sequence: TTC
cccagcacttgaaaatctta

SEQ ID NO: 302770 - DNA, 20 bp, Artificial Sequence
  Description of Artificial Sequence: Synthetic oligonucleotide
  Target: ATXN1; (+) strand; PAM type: YTN; PAM sequence: CTT
gaaaatcttaccaacaagaa

SEQ ID NO: 302771 - DNA, 20 bp, Artificial Sequence
  Description of Artificial Sequence: Synthetic oligonucleotide
  Target: ATXN1; (+) strand; PAM type: YTN; PAM sequence: TTG
aaaatcttaccaacaagaag

SEQ ID NO: 302772 - DNA, 20 bp, Artificial Sequence
  Description of Artificial Sequence: Synthetic oligonucleotide
  Target: ATXN1; (+) strand; PAM type: YTN; PAM sequence: CTT
accaacaagaagtacttccc

SEQ ID NO: 302773 - DNA, 20 bp, Artificial Sequence
  Description of Artificial Sequence: Synthetic oligonucleotide
  Target: ATXN1; (+) strand; PAM type: YTN; PAM sequence: TTA
ccaacaagaagtacttccca

SEQ ID NO: 302774 - DNA, 20 bp, Artificial Sequence
  Description of Artificial Sequence: Synthetic oligonucleotide
  Target: ATXN1; (+) strand; PAM type: YTN; PAM sequence: CTT
cccacactccggtcggtaat

SEQ ID NO: 302775 - DNA, 20 bp, Artificial Sequence
  Description of Artificial Sequence: Synthetic oligonucleotide
  Target: ATXN1; (+) strand; PAM type: YTN; PAM sequence: TTC
ccacactccggtcggtaatt

SEQ ID NO: 302776 - DNA, 20 bp, Artificial Sequence
  Description of Artificial Sequence: Synthetic oligonucleotide
  Target: ATXN1; (+) strand; PAM type: YTN; PAM sequence: CTC
cggtcggtaatttctgcact

SEQ ID NO: 302777 - DNA, 20 bp, Artificial Sequence
  Description of Artificial Sequence: Synthetic oligonucleotide
  Target: ATXN1; (+) strand; PAM type: YTN; PAM sequence: TTT
ctgcacttttttacttttcc

SEQ ID NO: 302778 - DNA, 20 bp, Artificial Sequence
  Description of Artificial Sequence: Synthetic oligonucleotide
  Target: ATXN1; (+) strand; PAM type: YTN; PAM sequence: TTC
tgcacttttttacttttcct

SEQ ID NO: 302779 - DNA, 20 bp, Artificial Sequence
  Description of Artificial Sequence: Synthetic oligonucleotide
  Target: ATXN1; (+) strand; PAM type: YTN; PAM sequence: CTG
cacttttttacttttccttt

SEQ ID NO: 302780 - DNA, 20 bp, Artificial Sequence
  Description of Artificial Sequence: Synthetic oligonucleotide
  Target: ATXN1; (+) strand; PAM type: YTN; PAM sequence: CTT
ttttacttttcctttgaagc

SEQ ID NO: 302781 - DNA, 20 bp, Artificial Sequence
  Description of Artificial Sequence: Synthetic oligonucleotide
  Target: ATXN1; (+) strand; PAM type: YTN; PAM sequence: TTT
tttacttttcctttgaagcc

SEQ ID NO: 302782 - DNA, 20 bp, Artificial Sequence
  Description of Artificial Sequence: Synthetic oligonucleotide
  Target: ATXN1; (+) strand; PAM type: YTN; PAM sequence: TTT
ttacttttcctttgaagccg

SEQ ID NO: 302783 - DNA, 20 bp, Artificial Sequence
  Description of Artificial Sequence: Synthetic oligonucleotide
  Target: ATXN1; (+) strand; PAM type: YTN; PAM sequence: TTT
tacttttcctttgaagccgc

SEQ ID NO: 302784 - DNA, 20 bp, Artificial Sequence
  Description of Artificial Sequence: Synthetic oligonucleotide
  Target: ATXN1; (+) strand; PAM type: YTN; PAM sequence: TTT
acttttcctttgaagccgca

SEQ ID NO: 302785 - DNA, 20 bp, Artificial Sequence
  Description of Artificial Sequence: Synthetic oligonucleotide
  Target: ATXN1; (+) strand; PAM type: YTN; PAM sequence: TTA
cttttcctttgaagccgcag

SEQ ID NO: 302786 - DNA, 20 bp, Artificial Sequence
  Description of Artificial Sequence: Synthetic oligonucleotide
  Target: ATXN1; (+) strand; PAM type: YTN; PAM sequence: CTT
ttcctttgaagccgcagtgc

SEQ ID NO: 302787 - DNA, 20 bp, Artificial Sequence
  Description of Artificial Sequence: Synthetic oligonucleotide
  Target: ATXN1; (+) strand; PAM type: YTN; PAM sequence: TTT
tcctttgaagccgcagtgca

SEQ ID NO: 302788 - DNA, 20 bp, Artificial Sequence
  Description of Artificial Sequence: Synthetic oligonucleotide
  Target: ATXN1; (+) strand; PAM type: YTN; PAM sequence: TTT
cctttgaagccgcagtgcaa

SEQ ID NO: 302789 - DNA, 20 bp, Artificial Sequence
  Description of Artificial Sequence: Synthetic oligonucleotide
  Target: ATXN1; (+) strand; PAM type: YTN; PAM sequence: TTC
ctttgaagccgcagtgcaat

SEQ ID NO: 302790 - DNA, 20 bp, Artificial Sequence
  Description of Artificial Sequence: Synthetic oligonucleotide
  Target: ATXN1; (+) strand; PAM type: YTN; PAM sequence: CTT
tgaagccgcagtgcaatgtg

SEQ ID NO: 302791 - DNA, 20 bp, Artificial Sequence
  Description of Artificial Sequence: Synthetic oligonucleotide
  Target: ATXN1; (+) strand; PAM type: YTN; PAM sequence: TTT
gaagccgcagtgcaatgtga

SEQ ID NO: 302792 - DNA, 20 bp, Artificial Sequence
  Description of Artificial Sequence: Synthetic oligonucleotide
  Target: ATXN1; (+) strand; PAM type: YTN; PAM sequence: TTG
aagccgcagtgcaatgtgat

SEQ ID NO: 302793 - DNA, 20 bp, Artificial Sequence
  Description of Artificial Sequence: Synthetic oligonucleotide
  Target: ATXN1; (+) strand; PAM type: YTN; PAM sequence: TTC
tacacccggggtgaaacaat

SEQ ID NO: 302794 - DNA, 20 bp, Artificial Sequence
  Description of Artificial Sequence: Synthetic oligonucleotide
  Target: ATXN1; (+) strand; PAM type: YTN; PAM sequence: CTA
cacccggggtgaaacaattc

SEQ ID NO: 302795 - DNA, 20 bp, Artificial Sequence
  Description of Artificial Sequence: Synthetic oligonucleotide
  Target: ATXN1; (+) strand; PAM type: YTN; PAM sequence: TTC
cttacggggagcctttggag

SEQ ID NO: 302796 - DNA, 20 bp, Artificial Sequence
  Description of Artificial Sequence: Synthetic oligonucleotide
  Target: ATXN1; (+) strand; PAM type: YTN; PAM sequence: CTT
acggggagcctttggagagc

SEQ ID NO: 302797 - DNA, 20 bp, Artificial Sequence
  Description of Artificial Sequence: Synthetic oligonucleotide
  Target: ATXN1; (+) strand; PAM type: YTN; PAM sequence: TTA
cggggagcctttggagagca

SEQ ID NO: 302798 - DNA, 20 bp, Artificial Sequence
  Description of Artificial Sequence: Synthetic oligonucleotide
  Target: ATXN1; (+) strand; PAM type: YTN; PAM sequence: CTT
tggagagcaccccaaacaag

SEQ ID NO: 302799 - DNA, 20 bp, Artificial Sequence
  Description of Artificial Sequence: Synthetic oligonucleotide
  Target: ATXN1; (+) strand; PAM type: YTN; PAM sequence: TTT
ggagagcaccccaaacaagg

SEQ ID NO: 302800 - DNA, 20 bp, Artificial Sequence
  Description of Artificial Sequence: Synthetic oligonucleotide
  Target: ATXN1; (+) strand; PAM type: YTN; PAM sequence: TTG
gagagcaccccaaacaaggg

SEQ ID NO: 302801 - DNA, 20 bp, Artificial Sequence
  Description of Artificial Sequence: Synthetic oligonucleotide
  Target: ATXN1; (+) strand; PAM type: YTN; PAM sequence: CTG
ctggaatgcaagtgtgatgc

SEQ ID NO: 302802 - DNA, 20 bp, Artificial Sequence
  Description of Artificial Sequence: Synthetic oligonucleotide
  Target: ATXN1; (+) strand; PAM type: YTN; PAM sequence: CTG
gaatgcaagtgtgatgccca

SEQ ID NO: 302803 - DNA, 20 bp, Artificial Sequence
  Description of Artificial Sequence: Synthetic oligonucleotide
  Target: ATXN1; (+) strand; PAM type: YTN; PAM sequence: CTG
tctccctacctcagagctga

SEQ ID NO: 302804 - DNA, 20 bp, Artificial Sequence
  Description of Artificial Sequence: Synthetic oligonucleotide
  Target: ATXN1; (+) strand; PAM type: YTN; PAM sequence: CTC
cctacctcagagctgaagtg

SEQ ID NO: 302805 - DNA, 20 bp, Artificial Sequence
  Description of Artificial Sequence: Synthetic oligonucleotide
  Target: ATXN1; (+) strand; PAM type: YTN; PAM sequence: CTA
cctcagagctgaagtgatca

SEQ ID NO: 302806 - DNA, 20 bp, Artificial Sequence
  Description of Artificial Sequence: Synthetic oligonucleotide
  Target: ATXN1; (+) strand; PAM type: YTN; PAM sequence: CTC
agagctgaagtgatcaaatg

SEQ ID NO: 302807 - DNA, 20 bp, Artificial Sequence
  Description of Artificial Sequence: Synthetic oligonucleotide
  Target: ATXN1; (+) strand; PAM type: YTN; PAM sequence: CTG
aagtgatcaaatgcttcttg

SEQ ID NO: 302808 - DNA, 20 bp, Artificial Sequence
  Description of Artificial Sequence: Synthetic oligonucleotide
  Target: ATXN1; (+) strand; PAM type: YTN; PAM sequence: CTT
cttgacaaccttcacgagaa

SEQ ID NO: 302809 - DNA, 20 bp, Artificial Sequence
  Description of Artificial Sequence: Synthetic oligonucleotide
  Target: ATXN1; (+) strand; PAM type: YTN; PAM sequence: TTC
ttgacaaccttcacgagaag

SEQ ID NO: 302810 - DNA, 20 bp, Artificial Sequence
  Description of Artificial Sequence: Synthetic oligonucleotide
  Target: ATXN1; (+) strand; PAM type: YTN; PAM sequence: CTT
gacaaccttcacgagaagtc

SEQ ID NO: 302811 - DNA, 20 bp, Artificial Sequence
  Description of Artificial Sequence: Synthetic oligonucleotide
  Target: ATXN1; (+) strand; PAM type: YTN; PAM sequence: TTG
acaaccttcacgagaagtct

SEQ ID NO: 302812 - DNA, 20 bp, Artificial Sequence
  Description of Artificial Sequence: Synthetic oligonucleotide
  Target: ATXN1; (+) strand; PAM type: YTN; PAM sequence: CTT
cacgagaagtctcaaagtta

SEQ ID NO: 302813 - DNA, 20 bp, Artificial Sequence
  Description of Artificial Sequence: Synthetic oligonucleotide
  Target: ATXN1; (+) strand; PAM type: YTN; PAM sequence: TTC
acgagaagtctcaaagttac

SEQ ID NO: 302814 - DNA, 20 bp, Artificial Sequence
  Description of Artificial Sequence: Synthetic oligonucleotide
  Target: ATXN1; (+) strand; PAM type: YTN; PAM sequence: CTC
aaagttacacacacaggctt

SEQ ID NO: 302815 - DNA, 20 bp, Artificial Sequence
  Description of Artificial Sequence: Synthetic oligonucleotide
  Target: ATXN1; (+) strand; PAM type: YTN; PAM sequence: TTA
cacacacaggcttagtcatt

SEQ ID NO: 302816 - DNA, 20 bp, Artificial Sequence
  Description of Artificial Sequence: Synthetic oligonucleotide
  Target: ATXN1; (+) strand; PAM type: YTN; PAM sequence: CTT
agtcatttccaaacgtctgc

SEQ ID NO: 302817 - DNA, 20 bp, Artificial Sequence
  Description of Artificial Sequence: Synthetic oligonucleotide
  Target: ATXN1; (+) strand; PAM type: YTN; PAM sequence: TTA
gtcatttccaaacgtctgca

SEQ ID NO: 302818 - DNA, 20 bp, Artificial Sequence
  Description of Artificial Sequence: Synthetic oligonucleotide
  Target: ATXN1; (+) strand; PAM type: YTN; PAM sequence: TTT
ccaaacgtctgcaccaatgt

SEQ ID NO: 302819 - DNA, 20 bp, Artificial Sequence
  Description of Artificial Sequence: Synthetic oligonucleotide
  Target: ATXN1; (+) strand; PAM type: YTN; PAM sequence: TTC
caaacgtctgcaccaatgtg

SEQ ID NO: 302820 - DNA, 20 bp, Artificial Sequence
  Description of Artificial Sequence: Synthetic oligonucleotide
  Target: ATXN1; (+) strand; PAM type: YTN; PAM sequence: CTG
caccaatgtgcagaactttt

SEQ ID NO: 302821 - DNA, 20 bp, Artificial Sequence
  Description of Artificial Sequence: Synthetic oligonucleotide
  Target: ATXN1; (+) strand; PAM type: YTN; PAM sequence: CTT
ttcctgccctgctctctaag

SEQ ID NO: 302822 - DNA, 20 bp, Artificial Sequence
  Description of Artificial Sequence: Synthetic oligonucleotide
  Target: ATXN1; (+) strand; PAM type: YTN; PAM sequence: TTT
tcctgccctgctctctaagc

SEQ ID NO: 302823 - DNA, 20 bp, Artificial Sequence
  Description of Artificial Sequence: Synthetic oligonucleotide
  Target: ATXN1; (+) strand; PAM type: YTN; PAM sequence: TTT
cctgccctgctctctaagca

SEQ ID NO: 302824 - DNA, 20 bp, Artificial Sequence
  Description of Artificial Sequence: Synthetic oligonucleotide
  Target: ATXN1; (+) strand; PAM type: YTN; PAM sequence: TTC
ctgccctgctctctaagcac

SEQ ID NO: 302825 - DNA, 20 bp, Artificial Sequence
  Description of Artificial Sequence: Synthetic oligonucleotide
  Target: ATXN1; (+) strand; PAM type: YTN; PAM sequence: CTG
ccctgctctctaagcactca

SEQ ID NO: 302826 - DNA, 20 bp, Artificial Sequence
  Description of Artificial Sequence: Synthetic oligonucleotide
  Target: ATXN1; (+) strand; PAM type: YTN; PAM sequence: CTG
ctctctaagcactcagcgag

SEQ ID NO: 302827 - DNA, 20 bp, Artificial Sequence
  Description of Artificial Sequence: Synthetic oligonucleotide
  Target: ATXN1; (+) strand; PAM type: YTN; PAM sequence: CTC
tctaagcactcagcgagggg

SEQ ID NO: 302828 - DNA, 20 bp, Artificial Sequence
  Description of Artificial Sequence: Synthetic oligonucleotide
  Target: ATXN1; (+) strand; PAM type: YTN; PAM sequence: CTC
taagcactcagcgaggggga

SEQ ID NO: 302829 - DNA, 20 bp, Artificial Sequence
  Description of Artificial Sequence: Synthetic oligonucleotide
  Target: ATXN1; (+) strand; PAM type: YTN; PAM sequence: CTA
agcactcagcgagggggagg

SEQ ID NO: 302830 - DNA, 20 bp, Artificial Sequence
  Description of Artificial Sequence: Synthetic oligonucleotide
  Target: ATXN1; (+) strand; PAM type: YTN; PAM sequence: CTC
agcgagggggagggggcaca

SEQ ID NO: 302831 - DNA, 20 bp, Artificial Sequence
  Description of Artificial Sequence: Synthetic oligonucleotide
  Target: ATXN1; (+) strand; PAM type: YTN; PAM sequence: CTG
tagccctacaccagtgctct

SEQ ID NO: 302832 - DNA, 20 bp, Artificial Sequence
  Description of Artificial Sequence: Synthetic oligonucleotide
  Target: ATXN1; (+) strand; PAM type: YTN; PAM sequence: CTA
caccagtgctctgcaggccc

SEQ ID NO: 302833 - DNA, 20 bp, Artificial Sequence
  Description of Artificial Sequence: Synthetic oligonucleotide
  Target: ATXN1; (+) strand; PAM type: YTN; PAM sequence: CTC
tgcaggcccccttgcctcct

SEQ ID NO: 302834 - DNA, 20 bp, Artificial Sequence
  Description of Artificial Sequence: Synthetic oligonucleotide
  Target: ATXN1; (+) strand; PAM type: YTN; PAM sequence: CTG
caggcccccttgcctcctca

SEQ ID NO: 302835 - DNA, 20 bp, Artificial Sequence
  Description of Artificial Sequence: Synthetic oligonucleotide
  Target: ATXN1; (+) strand; PAM type: YTN; PAM sequence: CTT
gcctcctcaggcctcacctc

SEQ ID NO: 302836 - DNA, 20 bp, Artificial Sequence
  Description of Artificial Sequence: Synthetic oligonucleotide
  Target: ATXN1; (+) strand; PAM type: YTN; PAM sequence: TTG
cctcctcaggcctcacctct

SEQ ID NO: 302837 - DNA, 20 bp, Artificial Sequence
  Description of Artificial Sequence: Synthetic oligonucleotide
  Target: ATXN1; (+) strand; PAM type: YTN; PAM sequence: CTC
ctcaggcctcacctctctca

SEQ ID NO: 302838 - DNA, 20 bp, Artificial Sequence
  Description of Artificial Sequence: Synthetic oligonucleotide
  Target: ATXN1; (+) strand; PAM type: YTN; PAM sequence: CTC
aggcctcacctctctcatct

SEQ ID NO: 302839 - DNA, 20 bp, Artificial Sequence
  Description of Artificial Sequence: Synthetic oligonucleotide
  Target: ATXN1; (+) strand; PAM type: YTN; PAM sequence: CTC
acctctctcatctgtaattg

SEQ ID NO: 302840 - DNA, 20 bp, Artificial Sequence
  Description of Artificial Sequence: Synthetic oligonucleotide
  Target: ATXN1; (+) strand; PAM type: YTN; PAM sequence: CTC
tctcatctgtaattgcagag

SEQ ID NO: 302841 - DNA, 20 bp, Artificial Sequence
  Description of Artificial Sequence: Synthetic oligonucleotide
  Target: ATXN1; (+) strand; PAM type: YTN; PAM sequence: CTC
tcatctgtaattgcagagat

SEQ ID NO: 302842 - DNA, 20 bp, Artificial Sequence
  Description of Artificial Sequence: Synthetic oligonucleotide
  Target: ATXN1; (+) strand; PAM type: YTN; PAM sequence: CTC
atctgtaattgcagagattg

SEQ ID NO: 302843 - DNA, 20 bp, Artificial Sequence
  Description of Artificial Sequence: Synthetic oligonucleotide
  Target: ATXN1; (+) strand; PAM type: YTN; PAM sequence: CTG
taattgcagagattggaccc

SEQ ID NO: 302844 - DNA, 20 bp, Artificial Sequence
  Description of Artificial Sequence: Synthetic oligonucleotide
  Target: ATXN1; (+) strand; PAM type: YTN; PAM sequence: TTG
cagagattggacccagtgat

SEQ ID NO: 302845 - DNA, 20 bp, Artificial Sequence
  Description of Artificial Sequence: Synthetic oligonucleotide
  Target: ATXN1; (+) strand; PAM type: YTN; PAM sequence: TTG
gacccagtgatcctaaaatc

SEQ ID NO: 302846 - DNA, 20 bp, Artificial Sequence
  Description of Artificial Sequence: Synthetic oligonucleotide
  Target: ATXN1; (+) strand; PAM type: YTN; PAM sequence: CTA
aaatccctacccgctggagc

SEQ ID NO: 302847 - DNA, 20 bp, Artificial Sequence
  Description of Artificial Sequence: Synthetic oligonucleotide
  Target: ATXN1; (+) strand; PAM type: YTN; PAM sequence: CTA
cccgctggagcatcctagag

SEQ ID NO: 302848 - DNA, 20 bp, Artificial Sequence
  Description of Artificial Sequence: Synthetic oligonucleotide
  Target: ATXN1; (+) strand; PAM type: YTN; PAM sequence: CTG
gagcatcctagagtctctgt

SEQ ID NO: 302849 - DNA, 20 bp, Artificial Sequence
  Description of Artificial Sequence: Synthetic oligonucleotide
  Target: ATXN1; (+) strand; PAM type: YTN; PAM sequence: CTA
gagtctctgtgacaggaata

SEQ ID NO: 302850 - DNA, 20 bp, Artificial Sequence
  Description of Artificial Sequence: Synthetic oligonucleotide
  Target: ATXN1; (+) strand; PAM type: YTN; PAM sequence: CTC
tgtgacaggaatatgacacg

SEQ ID NO: 302851 - DNA, 20 bp, Artificial Sequence
  Description of Artificial Sequence: Synthetic oligonucleotide
  Target: ATXN1; (+) strand; PAM type: YTN; PAM sequence: CTG
tgacaggaatatgacacgat

SEQ ID NO: 302852 - DNA, 20 bp, Artificial Sequence
  Description of Artificial Sequence: Synthetic oligonucleotide
  Target: ATXN1; (+) strand; PAM type: YTN; PAM sequence: TTG
cccacagcagttcacacaga

SEQ ID NO: 302853 - DNA, 20 bp, Artificial Sequence
  Description of Artificial Sequence: Synthetic oligonucleotide
  Target: ATXN1; (+) strand; PAM type: YTN; PAM sequence: TTC
acacagaagccaaaatccag

SEQ ID NO: 302854 - DNA, 20 bp, Artificial Sequence
  Description of Artificial Sequence: Synthetic oligonucleotide
  Target: ATXN1; (+) strand; PAM type: YTN; PAM sequence: CTA
tgctgggacttgggggaggg

SEQ ID NO: 302855 - DNA, 20 bp, Artificial Sequence
  Description of Artificial Sequence: Synthetic oligonucleotide
  Target: ATXN1; (+) strand; PAM type: YTN; PAM sequence: CTG
ggacttgggggagggctaaa

SEQ ID NO: 302856 - DNA, 20 bp, Artificial Sequence
  Description of Artificial Sequence: Synthetic oligonucleotide
  Target: ATXN1; (+) strand; PAM type: YTN; PAM sequence: CTT
gggggagggctaaagtgaag

SEQ ID NO: 302857 - DNA, 20 bp, Artificial Sequence
  Description of Artificial Sequence: Synthetic oligonucleotide
  Target: ATXN1; (+) strand; PAM type: YTN; PAM sequence: TTG
ggggagggctaaagtgaagg

SEQ ID NO: 302858 - DNA, 20 bp, Artificial Sequence
  Description of Artificial Sequence: Synthetic oligonucleotide
  Target: ATXN1; (+) strand; PAM type: YTN; PAM sequence: CTA
aagtgaaggcagggatcaga

SEQ ID NO: 302859 - DNA, 20 bp, Artificial Sequence
  Description of Artificial Sequence: Synthetic oligonucleotide
  Target: ATXN1; (+) strand; PAM type: YTN; PAM sequence: TTA
atgatacagaattccagacc

SEQ ID NO: 302860 - DNA, 20 bp, Artificial Sequence
  Description of Artificial Sequence: Synthetic oligonucleotide
  Target: ATXN1; (+) strand; PAM type: YTN; PAM sequence: TTC
cagacctacttcaaacaata

SEQ ID NO: 302861 - DNA, 20 bp, Artificial Sequence
  Description of Artificial Sequence: Synthetic oligonucleotide
  Target: ATXN1; (+) strand; PAM type: YTN; PAM sequence: CTA
cttcaaacaatagccctact

SEQ ID NO: 302862 - DNA, 20 bp, Artificial Sequence
  Description of Artificial Sequence: Synthetic oligonucleotide
  Target: ATXN1; (+) strand; PAM type: YTN; PAM sequence: CTT
caaacaatagccctactgtt

SEQ ID NO: 302863 - DNA, 20 bp, Artificial Sequence
  Description of Artificial Sequence: Synthetic oligonucleotide
  Target: ATXN1; (+) strand; PAM type: YTN; PAM sequence: TTC
aaacaatagccctactgttt

SEQ ID NO: 302864 - DNA, 20 bp, Artificial Sequence
  Description of Artificial Sequence: Synthetic oligonucleotide
  Target: ATXN1; (+) strand; PAM type: YTN; PAM sequence: CTA
ctgttttgctcaccccacac

SEQ ID NO: 302865 - DNA, 20 bp, Artificial Sequence
  Description of Artificial Sequence: Synthetic oligonucleotide
  Target: ATXN1; (+) strand; PAM type: YTN; PAM sequence: CTG
ttttgctcaccccacactag

SEQ ID NO: 302866 - DNA, 20 bp, Artificial Sequence
  Description of Artificial Sequence: Synthetic oligonucleotide
  Target: ATXN1; (+) strand; PAM type: YTN; PAM sequence: TTT
tgctcaccccacactaggtt

SEQ ID NO: 302867 - DNA, 20 bp, Artificial Sequence
  Description of Artificial Sequence: Synthetic oligonucleotide
  Target: ATXN1; (+) strand; PAM type: YTN; PAM sequence: TTT
gctcaccccacactaggttt

SEQ ID NO: 302868 - DNA, 20 bp, Artificial Sequence
  Description of Artificial Sequence: Synthetic oligonucleotide
  Target: ATXN1; (+) strand; PAM type: YTN; PAM sequence: TTG
ctcaccccacactaggtttt

SEQ ID NO: 302869 - DNA, 20 bp, Artificial Sequence
  Description of Artificial Sequence: Synthetic oligonucleotide
  Target: ATXN1; (+) strand; PAM type: YTN; PAM sequence: CTC
accccacactaggttttagg

SEQ ID NO: 302870 - DNA, 20 bp, Artificial Sequence
  Description of Artificial Sequence: Synthetic oligonucleotide
  Target: ATXN1; (+) strand; PAM type: YTN; PAM sequence: CTA
ggttttagggaaagagatat

SEQ ID NO: 302871 - DNA, 20 bp, Artificial Sequence
  Description of Artificial Sequence: Synthetic oligonucleotide
  Target: ATXN1; (+) strand; PAM type: YTN; PAM sequence: TTT
tagggaaagagatataagga

SEQ ID NO: 302872 - DNA, 20 bp, Artificial Sequence
  Description of Artificial Sequence: Synthetic oligonucleotide
  Target: ATXN1; (+) strand; PAM type: YTN; PAM sequence: TTT
agggaaagagatataaggat

SEQ ID NO: 302873 - DNA, 20 bp, Artificial Sequence
  Description of Artificial Sequence: Synthetic oligonucleotide
  Target: ATXN1; (+) strand; PAM type: YTN; PAM sequence: TTA
gggaaagagatataaggata

SEQ ID NO: 302874 - DNA, 20 bp, Artificial Sequence
  Description of Artificial Sequence: Synthetic oligonucleotide
  Target: ATXN1; (+) strand; PAM type: YTN; PAM sequence: CTC
gtcctctgtgaggtgactca

SEQ ID NO: 302875 - DNA, 20 bp, Artificial Sequence
  Description of Artificial Sequence: Synthetic oligonucleotide
  Target: ATXN1; (+) strand; PAM type: YTN; PAM sequence: CTC
tgtgaggtgactcaacagtc

SEQ ID NO: 302876 - DNA, 20 bp, Artificial Sequence
  Description of Artificial Sequence: Synthetic oligonucleotide
  Target: ATXN1; (+) strand; PAM type: YTN; PAM sequence: CTG
tgaggtgactcaacagtcac

SEQ ID NO: 302877 - DNA, 20 bp, Artificial Sequence
  Description of Artificial Sequence: Synthetic oligonucleotide
  Target: ATXN1; (+) strand; PAM type: YTN; PAM sequence: CTC
aacagtcacagacccaaact

SEQ ID NO: 302878 - DNA, 20 bp, Artificial Sequence
  Description of Artificial Sequence: Synthetic oligonucleotide
  Target: ATXN1; (+) strand; PAM type: YTN; PAM sequence: CTG
aatgatggagcagaataaaa

SEQ ID NO: 302879 - DNA, 20 bp, Artificial Sequence
  Description of Artificial Sequence: Synthetic oligonucleotide
  Target: ATXN1; (+) strand; PAM type: YTN; PAM sequence: TTC
tttccctgatccagtaagtc

SEQ ID NO: 302880 - DNA, 20 bp, Artificial Sequence
  Description of Artificial Sequence: Synthetic oligonucleotide
  Target: ATXN1; (+) strand; PAM type: YTN; PAM sequence: CTT
tccctgatccagtaagtcac

SEQ ID NO: 302881 - DNA, 20 bp, Artificial Sequence
  Description of Artificial Sequence: Synthetic oligonucleotide
  Target: ATXN1; (+) strand; PAM type: YTN; PAM sequence: TTT
ccctgatccagtaagtcacg

SEQ ID NO: 302882 - DNA, 20 bp, Artificial Sequence
  Description of Artificial Sequence: Synthetic oligonucleotide
  Target: ATXN1; (+) strand; PAM type: YTN; PAM sequence: TTC
cctgatccagtaagtcacgg

SEQ ID NO: 302883 - DNA, 20 bp, Artificial Sequence
  Description of Artificial Sequence: Synthetic oligonucleotide
  Target: ATXN1; (+) strand; PAM type: YTN; PAM sequence: CTG
atccagtaagtcacggaggc

SEQ ID NO: 302884 - DNA, 20 bp, Artificial Sequence
  Description of Artificial Sequence: Synthetic oligonucleotide
  Target: ATXN1; (+) strand; PAM type: YTN; PAM sequence: TTC
ctgagatccagacctattta

SEQ ID NO: 302885 - DNA, 20 bp, Artificial Sequence
  Description of Artificial Sequence: Synthetic oligonucleotide
  Target: ATXN1; (+) strand; PAM type: YTN; PAM sequence: CTG
agatccagacctatttatac

SEQ ID NO: 302886 - DNA, 20 bp, Artificial Sequence
  Description of Artificial Sequence: Synthetic oligonucleotide
  Target: ATXN1; (+) strand; PAM type: YTN; PAM sequence: CTA
tttatacaagtgcaggctgg

SEQ ID NO: 302887 - DNA, 20 bp, Artificial Sequence
  Description of Artificial Sequence: Synthetic oligonucleotide
  Target: ATXN1; (+) strand; PAM type: YTN; PAM sequence: TTT
atacaagtgcaggctgggca

SEQ ID NO: 302888 - DNA, 20 bp, Artificial Sequence
  Description of Artificial Sequence: Synthetic oligonucleotide
  Target: ATXN1; (+) strand; PAM type: YTN; PAM sequence: TTA
tacaagtgcaggctgggcac

SEQ ID NO: 302889 - DNA, 20 bp, Artificial Sequence
  Description of Artificial Sequence: Synthetic oligonucleotide
  Target: ATXN1; (+) strand; PAM type: YTN; PAM sequence: CTG
ggcacctttccctgaaggtc

SEQ ID NO: 302890 - DNA, 20 bp, Artificial Sequence
  Description of Artificial Sequence: Synthetic oligonucleotide
  Target: ATXN1; (+) strand; PAM type: YTN; PAM sequence: CTT
tccctgaaggtcccactcag

SEQ ID NO: 302891 - DNA, 20 bp, Artificial Sequence
  Description of Artificial Sequence: Synthetic oligonucleotide
  Target: ATXN1; (+) strand; PAM type: YTN; PAM sequence: TTT
ccctgaaggtcccactcagt

SEQ ID NO: 302892 - DNA, 20 bp, Artificial Sequence
  Description of Artificial Sequence: Synthetic oligonucleotide
  Target: ATXN1; (+) strand; PAM type: YTN; PAM sequence: TTC
cctgaaggtcccactcagtt

SEQ ID NO: 302893 - DNA, 20 bp, Artificial Sequence
  Description of Artificial Sequence: Synthetic oligonucleotide
  Target: ATXN1; (+) strand; PAM type: YTN; PAM sequence: CTG
aaggtcccactcagttattc

SEQ ID NO: 302894 - DNA, 20 bp, Artificial Sequence
  Description of Artificial Sequence: Synthetic oligonucleotide
  Target: ATXN1; (+) strand; PAM type: YTN; PAM sequence: CTC
agttattctcttggttcccc

SEQ ID NO: 302895 - DNA, 20 bp, Artificial Sequence
  Description of Artificial Sequence: Synthetic oligonucleotide
  Target: ATXN1; (+) strand; PAM type: YTN; PAM sequence: TTA
ttctcttggttccccaatca

SEQ ID NO: 302896 - DNA, 20 bp, Artificial Sequence
  Description of Artificial Sequence: Synthetic oligonucleotide
  Target: ATXN1; (+) strand; PAM type: YTN; PAM sequence: TTC
tcttggttccccaatcacag

SEQ ID NO: 302897 - DNA, 20 bp, Artificial Sequence
  Description of Artificial Sequence: Synthetic oligonucleotide
  Target: ATXN1; (+) strand; PAM type: YTN; PAM sequence: CTC
ttggttccccaatcacagtg

SEQ ID NO: 302898 - DNA, 20 bp, Artificial Sequence
  Description of Artificial Sequence: Synthetic oligonucleotide
  Target: ATXN1; (+) strand; PAM type: YTN; PAM sequence: CTT
ggttccccaatcacagtgag

SEQ ID NO: 302899 - DNA, 20 bp, Artificial Sequence
  Description of Artificial Sequence: Synthetic oligonucleotide
  Target: ATXN1; (+) strand; PAM type: YTN; PAM sequence: TTG
gttccccaatcacagtgagt

SEQ ID NO: 302900 - DNA, 20 bp, Artificial Sequence
  Description of Artificial Sequence: Synthetic oligonucleotide
  Target: ATXN1; (+) strand; PAM type: YTN; PAM sequence: TTC
cccaatcacagtgagtggtg

SEQ ID NO: 302901 - DNA, 20 bp, Artificial Sequence
  Description of Artificial Sequence: Synthetic oligonucleotide
  Target: ATXN1; (+) strand; PAM type: YTN; PAM sequence: TTT
gcccattcacttcctcaaac

SEQ ID NO: 302902 - DNA, 20 bp, Artificial Sequence
  Description of Artificial Sequence: Synthetic oligonucleotide
  Target: ATXN1; (+) strand; PAM type: YTN; PAM sequence: TTG
cccattcacttcctcaaacc

SEQ ID NO: 302903 - DNA, 20 bp, Artificial Sequence
  Description of Artificial Sequence: Synthetic oligonucleotide
  Target: ATXN1; (+) strand; PAM type: YTN; PAM sequence: TTC
acttcctcaaaccagacact

SEQ ID NO: 302904 - DNA, 20 bp, Artificial Sequence
  Description of Artificial Sequence: Synthetic oligonucleotide
  Target: ATXN1; (+) strand; PAM type: YTN; PAM sequence: CTT
cctcaaaccagacactaccc

SEQ ID NO: 302905 - DNA, 20 bp, Artificial Sequence
  Description of Artificial Sequence: Synthetic oligonucleotide
  Target: ATXN1; (+) strand; PAM type: YTN; PAM sequence: TTC
ctcaaaccagacactacccc

SEQ ID NO: 302906 - DNA, 20 bp, Artificial Sequence
  Description of Artificial Sequence: Synthetic oligonucleotide
  Target: ATXN1; (+) strand; PAM type: YTN; PAM sequence: CTC
aaaccagacactacccccct

SEQ ID NO: 302907 - DNA, 20 bp, Artificial Sequence
  Description of Artificial Sequence: Synthetic oligonucleotide
  Target: ATXN1; (+) strand; PAM type: YTN; PAM sequence: CTA
cccccctctcattcacttcc

SEQ ID NO: 302908 - DNA, 20 bp, Artificial Sequence
  Description of Artificial Sequence: Synthetic oligonucleotide
  Target: ATXN1; (+) strand; PAM type: YTN; PAM sequence: CTC
tcattcacttccaatatcta

SEQ ID NO: 302909 - DNA, 20 bp, Artificial Sequence
  Description of Artificial Sequence: Synthetic oligonucleotide
  Target: ATXN1; (+) strand; PAM type: YTN; PAM sequence: CTC
attcacttccaatatctaat

SEQ ID NO: 302910 - DNA, 20 bp, Artificial Sequence
  Description of Artificial Sequence: Synthetic oligonucleotide
  Target: ATXN1; (+) strand; PAM type: YTN; PAM sequence: TTC
acttccaatatctaattgct

SEQ ID NO: 302911 - DNA, 20 bp, Artificial Sequence
  Description of Artificial Sequence: Synthetic oligonucleotide
  Target: ATXN1; (+) strand; PAM type: YTN; PAM sequence: CTT
ccaatatctaattgctcatc

SEQ ID NO: 302912 - DNA, 20 bp, Artificial Sequence
  Description of Artificial Sequence: Synthetic oligonucleotide
  Target: ATXN1; (+) strand; PAM type: YTN; PAM sequence: TTC
caatatctaattgctcatca

SEQ ID NO: 302913 - DNA, 20 bp, Artificial Sequence
  Description of Artificial Sequence: Synthetic oligonucleotide
  Target: ATXN1; (+) strand; PAM type: YTN; PAM sequence: CTA
attgctcatcaagtcctcta

SEQ ID NO: 302914 - DNA, 20 bp, Artificial Sequence
  Description of Artificial Sequence: Synthetic oligonucleotide
  Target: ATXN1; (+) strand; PAM type: YTN; PAM sequence: TTG
ctcatcaagtcctctaaatc

SEQ ID NO: 302915 - DNA, 20 bp, Artificial Sequence
  Description of Artificial Sequence: Synthetic oligonucleotide
  Target: ATXN1; (+) strand; PAM type: YTN; PAM sequence: CTC
atcaagtcctctaaatcctt

SEQ ID NO: 302916 - DNA, 20 bp, Artificial Sequence
  Description of Artificial Sequence: Synthetic oligonucleotide
  Target: ATXN1; (+) strand; PAM type: YTN; PAM sequence: CTC
taaatccttgcttattaaca

SEQ ID NO: 302917 - DNA, 20 bp, Artificial Sequence
  Description of Artificial Sequence: Synthetic oligonucleotide
  Target: ATXN1; (+) strand; PAM type: YTN; PAM sequence: CTA
aatccttgcttattaacatc

SEQ ID NO: 302918 - DNA, 20 bp, Artificial Sequence
  Description of Artificial Sequence: Synthetic oligonucleotide
  Target: ATXN1; (+) strand; PAM type: YTN; PAM sequence: CTT
gcttattaacatctctccaa

SEQ ID NO: 302919 - DNA, 20 bp, Artificial Sequence
  Description of Artificial Sequence: Synthetic oligonucleotide
  Target: ATXN1; (+) strand; PAM type: YTN; PAM sequence: TTG
cttattaacatctctccaat

SEQ ID NO: 302920 - DNA, 20 bp, Artificial Sequence
  Description of Artificial Sequence: Synthetic oligonucleotide
  Target: ATXN1; (+) strand; PAM type: YTN; PAM sequence: CTT
attaacatctctccaatctg

SEQ ID NO: 302921 - DNA, 20 bp, Artificial Sequence
  Description of Artificial Sequence: Synthetic oligonucleotide
  Target: ATXN1; (+) strand; PAM type: YTN; PAM sequence: TTA
ttaacatctctccaatctgc

SEQ ID NO: 302922 - DNA, 20 bp, Artificial Sequence
  Description of Artificial Sequence: Synthetic oligonucleotide
  Target: ATXN1; (+) strand; PAM type: YTN; PAM sequence: TTA
acatctctccaatctgctca

SEQ ID NO: 302923 - DNA, 20 bp, Artificial Sequence
  Description of Artificial Sequence: Synthetic oligonucleotide
  Target: ATXN1; (+) strand; PAM type: YTN; PAM sequence: CTC
tccaatctgctcattctttc

SEQ ID NO: 302924 - DNA, 20 bp, Artificial Sequence
  Description of Artificial Sequence: Synthetic oligonucleotide
  Target: ATXN1; (+) strand; PAM type: YTN; PAM sequence: CTC
caatctgctcattctttcca

SEQ ID NO: 302925 - DNA, 20 bp, Artificial Sequence
  Description of Artificial Sequence: Synthetic oligonucleotide
  Target: ATXN1; (+) strand; PAM type: YTN; PAM sequence: CTG
ctcattctttccattctgtc

SEQ ID NO: 302926 - DNA, 20 bp, Artificial Sequence
  Description of Artificial Sequence: Synthetic oligonucleotide
  Target: ATXN1; (+) strand; PAM type: YTN; PAM sequence: CTC
attctttccattctgtcact

SEQ ID NO: 302927 - DNA, 20 bp, Artificial Sequence
  Description of Artificial Sequence: Synthetic oligonucleotide
  Target: ATXN1; (+) strand; PAM type: YTN; PAM sequence: TTC
tttccattctgtcacttcca

SEQ ID NO: 302928 - DNA, 20 bp, Artificial Sequence
  Description of Artificial Sequence: Synthetic oligonucleotide
  Target: ATXN1; (+) strand; PAM type: YTN; PAM sequence: CTT
tccattctgtcacttccatt

SEQ ID NO: 302929 - DNA, 20 bp, Artificial Sequence
  Description of Artificial Sequence: Synthetic oligonucleotide
  Target: ATXN1; (+) strand; PAM type: YTN; PAM sequence: TTT
ccattctgtcacttccattg

SEQ ID NO: 302930 - DNA, 20 bp, Artificial Sequence
  Description of Artificial Sequence: Synthetic oligonucleotide
  Target: ATXN1; (+) strand; PAM type: YTN; PAM sequence: TTC
cattctgtcacttccattgc

SEQ ID NO: 302931 - DNA, 20 bp, Artificial Sequence
  Description of Artificial Sequence: Synthetic oligonucleotide
  Target: ATXN1; (+) strand; PAM type: YTN; PAM sequence: TTC
tgtcacttccattgccactc

SEQ ID NO: 302932 - DNA, 20 bp, Artificial Sequence
  Description of Artificial Sequence: Synthetic oligonucleotide
  Target: ATXN1; (+) strand; PAM type: YTN; PAM sequence: CTG
tcacttccattgccactcca

SEQ ID NO: 302933 - DNA, 20 bp, Artificial Sequence
  Description of Artificial Sequence: Synthetic oligonucleotide
  Target: ATXN1; (+) strand; PAM type: YTN; PAM sequence: CTT
ccattgccactccaaactcc

SEQ ID NO: 302934 - DNA, 20 bp, Artificial Sequence
  Description of Artificial Sequence: Synthetic oligonucleotide
  Target: ATXN1; (+) strand; PAM type: YTN; PAM sequence: TTC
cattgccactccaaactcca

SEQ ID NO: 302935 - DNA, 20 bp, Artificial Sequence
  Description of Artificial Sequence: Synthetic oligonucleotide
  Target: ATXN1; (+) strand; PAM type: YTN; PAM sequence: TTG
ccactccaaactccatgaga

SEQ ID NO: 302936 - DNA, 20 bp, Artificial Sequence
  Description of Artificial Sequence: Synthetic oligonucleotide
  Target: ATXN1; (+) strand; PAM type: YTN; PAM sequence: CTC
caaactccatgagaacaagg

SEQ ID NO: 302937 - DNA, 20 bp, Artificial Sequence
  Description of Artificial Sequence: Synthetic oligonucleotide
  Target: ATXN1; (+) strand; PAM type: YTN; PAM sequence: CTC
catgagaacaaggggcctgt

SEQ ID NO: 302938 - DNA, 20 bp, Artificial Sequence
  Description of Artificial Sequence: Synthetic oligonucleotide
  Target: ATXN1; (+) strand; PAM type: YTN; PAM sequence: CTG
tctgtcctggtccctgcaga

SEQ ID NO: 302939 - DNA, 20 bp, Artificial Sequence
  Description of Artificial Sequence: Synthetic oligonucleotide
  Target: ATXN1; (+) strand; PAM type: YTN; PAM sequence: CTG
tcctggtccctgcagaagcc

SEQ ID NO: 302940 - DNA, 20 bp, Artificial Sequence
  Description of Artificial Sequence: Synthetic oligonucleotide
  Target: ATXN1; (+) strand; PAM type: YTN; PAM sequence: CTG
gtccctgcagaagccgcagc

SEQ ID NO: 302941 - DNA, 20 bp, Artificial Sequence
  Description of Artificial Sequence: Synthetic oligonucleotide
  Target: ATXN1; (+) strand; PAM type: YTN; PAM sequence: CTG
cagaagccgcagcacacaga

SEQ ID NO: 302942 - DNA, 20 bp, Artificial Sequence
  Description of Artificial Sequence: Synthetic oligonucleotide
  Target: ATXN1; (+) strand; PAM type: YTN; PAM sequence: CTG
tgattagcatgaagcaggtg

SEQ ID NO: 302943 - DNA, 20 bp, Artificial Sequence
  Description of Artificial Sequence: Synthetic oligonucleotide
  Target: ATXN1; (+) strand; PAM type: YTN; PAM sequence: TTA
gcatgaagcaggtgctctgt

SEQ ID NO: 302944 - DNA, 20 bp, Artificial Sequence
  Description of Artificial Sequence: Synthetic oligonucleotide
  Target: ATXN1; (+) strand; PAM type: YTN; PAM sequence: CTC
tgtggttctggaattttcaa

SEQ ID NO: 302945 - DNA, 20 bp, Artificial Sequence
  Description of Artificial Sequence: Synthetic oligonucleotide
  Target: ATXN1; (+) strand; PAM type: YTN; PAM sequence: CTG
tggttctggaattttcaaca

SEQ ID NO: 302946 - DNA, 20 bp, Artificial Sequence
  Description of Artificial Sequence: Synthetic oligonucleotide
  Target: ATXN1; (+) strand; PAM type: YTN; PAM sequence: TTC
tggaattttcaacattcctc

SEQ ID NO: 302947 - DNA, 20 bp, Artificial Sequence
  Description of Artificial Sequence: Synthetic oligonucleotide
  Target: ATXN1; (+) strand; PAM type: YTN; PAM sequence: CTG
gaattttcaacattcctctg

SEQ ID NO: 302948 - DNA, 20 bp, Artificial Sequence
  Description of Artificial Sequence: Synthetic oligonucleotide
  Target: ATXN1; (+) strand; PAM type: YTN; PAM sequence: TTT
tcaacattcctctgtcacct

SEQ ID NO: 302949 - DNA, 20 bp, Artificial Sequence
  Description of Artificial Sequence: Synthetic oligonucleotide
  Target: ATXN1; (+) strand; PAM type: YTN; PAM sequence: TTT
caacattcctctgtcacctg

SEQ ID NO: 302950 - DNA, 20 bp, Artificial Sequence
  Description of Artificial Sequence: Synthetic oligonucleotide
  Target: ATXN1; (+) strand; PAM type: YTN; PAM sequence: TTC
aacattcctctgtcacctgg

SEQ ID NO: 302951 - DNA, 20 bp, Artificial Sequence
  Description of Artificial Sequence: Synthetic oligonucleotide
  Target: ATXN1; (+) strand; PAM type: YTN; PAM sequence: TTC
ctctgtcacctggatttcta

SEQ ID NO: 302952 - DNA, 20 bp, Artificial Sequence
  Description of Artificial Sequence: Synthetic oligonucleotide
  Target: ATXN1; (+) strand; PAM type: YTN; PAM sequence: CTC
tgtcacctggatttctacaa

SEQ ID NO: 302953 - DNA, 20 bp, Artificial Sequence
  Description of Artificial Sequence: Synthetic oligonucleotide
  Target: ATXN1; (+) strand; PAM type: YTN; PAM sequence: CTG
tcacctggatttctacaact

SEQ ID NO: 302954 - DNA, 20 bp, Artificial Sequence
  Description of Artificial Sequence: Synthetic oligonucleotide
  Target: ATXN1; (+) strand; PAM type: YTN; PAM sequence: CTG
gatttctacaactgcttcct

SEQ ID NO: 302955 - DNA, 20 bp, Artificial Sequence
  Description of Artificial Sequence: Synthetic oligonucleotide
  Target: ATXN1; (+) strand; PAM type: YTN; PAM sequence: TTT
ctacaactgcttcctctctg

SEQ ID NO: 302956 - DNA, 20 bp, Artificial Sequence
  Description of Artificial Sequence: Synthetic oligonucleotide
  Target: ATXN1; (+) strand; PAM type: YTN; PAM sequence: TTC
tacaactgcttcctctctgg

SEQ ID NO: 302957 - DNA, 20 bp, Artificial Sequence
  Description of Artificial Sequence: Synthetic oligonucleotide
  Target: ATXN1; (+) strand; PAM type: YTN; PAM sequence: CTA
caactgcttcctctctggtc

SEQ ID NO: 302958 - DNA, 20 bp, Artificial Sequence
  Description of Artificial Sequence: Synthetic oligonucleotide
  Target: ATXN1; (+) strand; PAM type: YTN; PAM sequence: CTG
cttcctctctggtctccttg

SEQ ID NO: 302959 - DNA, 20 bp, Artificial Sequence
  Description of Artificial Sequence: Synthetic oligonucleotide
  Target: ATXN1; (+) strand; PAM type: YTN; PAM sequence: CTT
cctctctggtctccttgccc

SEQ ID NO: 302960 - DNA, 20 bp, Artificial Sequence
  Description of Artificial Sequence: Synthetic oligonucleotide
  Target: ATXN1; (+) strand; PAM type: YTN; PAM sequence: TTC
ctctctggtctccttgccca

SEQ ID NO: 302961 - DNA, 20 bp, Artificial Sequence
  Description of Artificial Sequence: Synthetic oligonucleotide
  Target: ATXN1; (+) strand; PAM type: YTN; PAM sequence: CTC
tctggtctccttgcccacca

SEQ ID NO: 302962 - DNA, 20 bp, Artificial Sequence
  Description of Artificial Sequence: Synthetic oligonucleotide
  Target: ATXN1; (+) strand; PAM type: YTN; PAM sequence: CTC
tggtctccttgcccaccacc

SEQ ID NO: 302963 - DNA, 20 bp, Artificial Sequence
  Description of Artificial Sequence: Synthetic oligonucleotide
  Target: ATXN1; (+) strand; PAM type: YTN; PAM sequence: CTG
gtctccttgcccaccacctg

SEQ ID NO: 302964 - DNA, 20 bp, Artificial Sequence
  Description of Artificial Sequence: Synthetic oligonucleotide
  Target: ATXN1; (+) strand; PAM type: YTN; PAM sequence: CTC
cttgcccaccacctggtccc

SEQ ID NO: 302965 - DNA, 20 bp, Artificial Sequence
  Description of Artificial Sequence: Synthetic oligonucleotide
  Target: ATXN1; (+) strand; PAM type: YTN; PAM sequence: CTT
gcccaccacctggtccctta

SEQ ID NO: 302966 - DNA, 20 bp, Artificial Sequence
  Description of Artificial Sequence: Synthetic oligonucleotide
  Target: ATXN1; (+) strand; PAM type: YTN; PAM sequence: TTG
cccaccacctggtcccttat

SEQ ID NO: 302967 - DNA, 20 bp, Artificial Sequence
  Description of Artificial Sequence: Synthetic oligonucleotide
  Target: ATXN1; (+) strand; PAM type: YTN; PAM sequence: CTG
gtcccttatcatgccaaatg

SEQ ID NO: 302968 - DNA, 20 bp, Artificial Sequence
  Description of Artificial Sequence: Synthetic oligonucleotide
  Target: ATXN1; (+) strand; PAM type: YTN; PAM sequence: CTT
atcatgccaaatgcatagca

SEQ ID NO: 302969 - DNA, 20 bp, Artificial Sequence
  Description of Artificial Sequence: Synthetic oligonucleotide
  Target: ATXN1; (+) strand; PAM type: YTN; PAM sequence: TTA
tcatgccaaatgcatagcac

SEQ ID NO: 302970 - DNA, 20 bp, Artificial Sequence
  Description of Artificial Sequence: Synthetic oligonucleotide
  Target: ATXN1; (+) strand; PAM type: YTN; PAM sequence: CTA
acagaatgaaatcactgaaa

SEQ ID NO: 302971 - DNA, 20 bp, Artificial Sequence
  Description of Artificial Sequence: Synthetic oligonucleotide
  Target: ATXN1; (+) strand; PAM type: YTN; PAM sequence: CTG
aaacacacacctgacttttc

SEQ ID NO: 302972 - DNA, 20 bp, Artificial Sequence
  Description of Artificial Sequence: Synthetic oligonucleotide
  Target: ATXN1; (+) strand; PAM type: YTN; PAM sequence: CTG
acttttcacatccctacagt

SEQ ID NO: 302973 - DNA, 20 bp, Artificial Sequence
  Description of Artificial Sequence: Synthetic oligonucleotide
  Target: ATXN1; (+) strand; PAM type: YTN; PAM sequence: CTT
ttcacatccctacagtcctt

SEQ ID NO: 302974 - DNA, 20 bp, Artificial Sequence
  Description of Artificial Sequence: Synthetic oligonucleotide
  Target: ATXN1; (+) strand; PAM type: YTN; PAM sequence: TTT
tcacatccctacagtccttg

SEQ ID NO: 302975 - DNA, 20 bp, Artificial Sequence
  Description of Artificial Sequence: Synthetic oligonucleotide
  Target: ATXN1; (+) strand; PAM type: YTN; PAM sequence: TTT
cacatccctacagtccttga

SEQ ID NO: 302976 - DNA, 20 bp, Artificial Sequence
  Description of Artificial Sequence: Synthetic oligonucleotide
  Target: ATXN1; (+) strand; PAM type: YTN; PAM sequence: TTC
acatccctacagtccttgaa

SEQ ID NO: 302977 - DNA, 20 bp, Artificial Sequence
  Description of Artificial Sequence: Synthetic oligonucleotide
  Target: ATXN1; (+) strand; PAM type: YTN; PAM sequence: CTA
cagtccttgaatgggtctac

SEQ ID NO: 302978 - DNA, 20 bp, Artificial Sequence
  Description of Artificial Sequence: Synthetic oligonucleotide
  Target: ATXN1; (+) strand; PAM type: YTN; PAM sequence: CTT
gaatgggtctacattgcatc

SEQ ID NO: 302979 - DNA, 20 bp, Artificial Sequence
  Description of Artificial Sequence: Synthetic oligonucleotide
  Target: ATXN1; (+) strand; PAM type: YTN; PAM sequence: TTG
aatgggtctacattgcatcc

SEQ ID NO: 302980 - DNA, 20 bp, Artificial Sequence
  Description of Artificial Sequence: Synthetic oligonucleotide
  Target: ATXN1; (+) strand; PAM type: YTN; PAM sequence: CTA
cattgcatccaagataaaat

SEQ ID NO: 302981 - DNA, 20 bp, Artificial Sequence
  Description of Artificial Sequence: Synthetic oligonucleotide
  Target: ATXN1; (+) strand; PAM type: YTN; PAM sequence: TTG
catccaagataaaatccaag

SEQ ID NO: 302982 - DNA, 20 bp, Artificial Sequence
  Description of Artificial Sequence: Synthetic oligonucleotide
  Target: ATXN1; (+) strand; PAM type: YTN; PAM sequence: CTC
tgcttggctcacaagggccc

SEQ ID NO: 302983 - DNA, 20 bp, Artificial Sequence
  Description of Artificial Sequence: Synthetic oligonucleotide
  Target: ATXN1; (+) strand; PAM type: YTN; PAM sequence: CTG
cttggctcacaagggccctt

SEQ ID NO: 302984 - DNA, 20 bp, Artificial Sequence
  Description of Artificial Sequence: Synthetic oligonucleotide
  Target: ATXN1; (+) strand; PAM type: YTN; PAM sequence: CTT
ggctcacaagggcccttcct

SEQ ID NO: 302985 - DNA, 20 bp, Artificial Sequence
  Description of Artificial Sequence: Synthetic oligonucleotide
  Target: ATXN1; (+) strand; PAM type: YTN; PAM sequence: TTG
gctcacaagggcccttcctg

SEQ ID NO: 302986 - DNA, 20 bp, Artificial Sequence
  Description of Artificial Sequence: Synthetic oligonucleotide
  Target: ATXN1; (+) strand; PAM type: YTN; PAM sequence: CTC
acaagggcccttcctgatcg

SEQ ID NO: 302987 - DNA, 20 bp, Artificial Sequence
  Description of Artificial Sequence: Synthetic oligonucleotide
  Target: ATXN1; (+) strand; PAM type: YTN; PAM sequence: CTT
cctgatcgagaccctgagcc

SEQ ID NO: 302988 - DNA, 20 bp, Artificial Sequence
  Description of Artificial Sequence: Synthetic oligonucleotide
  Target: ATXN1; (+) strand; PAM type: YTN; PAM sequence: TTC
ctgatcgagaccctgagccc

SEQ ID NO: 302989 - DNA, 20 bp, Artificial Sequence
  Description of Artificial Sequence: Synthetic oligonucleotide
  Target: ATXN1; (+) strand; PAM type: YTN; PAM sequence: CTG
atcgagaccctgagcccctc

SEQ ID NO: 302990 - DNA, 20 bp, Artificial Sequence
  Description of Artificial Sequence: Synthetic oligonucleotide
  Target: ATXN1; (+) strand; PAM type: YTN; PAM sequence: CTG
agcccctctagcggtgtcag

SEQ ID NO: 302991 - DNA, 20 bp, Artificial Sequence
  Description of Artificial Sequence: Synthetic oligonucleotide
  Target: ATXN1; (+) strand; PAM type: YTN; PAM sequence: CTC
tagcggtgtcaggcctgcct

SEQ ID NO: 302992 - DNA, 20 bp, Artificial Sequence
  Description of Artificial Sequence: Synthetic oligonucleotide
  Target: ATXN1; (+) strand; PAM type: YTN; PAM sequence: CTA
gcggtgtcaggcctgcctca

SEQ ID NO: 302993 - DNA, 20 bp, Artificial Sequence
  Description of Artificial Sequence: Synthetic oligonucleotide
  Target: ATXN1; (+) strand; PAM type: YTN; PAM sequence: CTG
cctcactatggacctaccaa

SEQ ID NO: 302994 - DNA, 20 bp, Artificial Sequence
  Description of Artificial Sequence: Synthetic oligonucleotide
  Target: ATXN1; (+) strand; PAM type: YTN; PAM sequence: CTC
actatggacctaccaaactg

SEQ ID NO: 302995 - DNA, 20 bp, Artificial Sequence
  Description of Artificial Sequence: Synthetic oligonucleotide
  Target: ATXN1; (+) strand; PAM type: YTN; PAM sequence: CTA
tggacctaccaaactgctta

SEQ ID NO: 302996 - DNA, 20 bp, Artificial Sequence
  Description of Artificial Sequence: Synthetic oligonucleotide
  Target: ATXN1; (+) strand; PAM type: YTN; PAM sequence: CTA
ccaaactgcttattgctcct

SEQ ID NO: 302997 - DNA, 20 bp, Artificial Sequence
  Description of Artificial Sequence: Synthetic oligonucleotide
  Target: ATXN1; (+) strand; PAM type: YTN; PAM sequence: CTG
cttattgctccttcagccca

SEQ ID NO: 302998 - DNA, 20 bp, Artificial Sequence
  Description of Artificial Sequence: Synthetic oligonucleotide
  Target: ATXN1; (+) strand; PAM type: YTN; PAM sequence: CTT
attgctccttcagcccatcc

SEQ ID NO: 302999 - DNA, 20 bp, Artificial Sequence
  Description of Artificial Sequence: Synthetic oligonucleotide
  Target: ATXN1; (+) strand; PAM type: YTN; PAM sequence: TTA
ttgctccttcagcccatcca

SEQ ID NO: 303000 - DNA, 20 bp, Artificial Sequence
  Description of Artificial Sequence: Synthetic oligonucleotide
  Target: ATXN1; (+) strand; PAM type: YTN; PAM sequence: TTG
ctccttcagcccatccatat

SEQ ID NO: 303001 - DNA, 20 bp, Artificial Sequence
  Description of Artificial Sequence: Synthetic oligonucleotide
  Target: ATXN1; (+) strand; PAM type: YTN; PAM sequence: CTC
cttcagcccatccatataat

SEQ ID NO: 303002 - DNA, 20 bp, Artificial Sequence
  Description of Artificial Sequence: Synthetic oligonucleotide
  Target: ATXN1; (+) strand; PAM type: YTN; PAM sequence: CTT
cagcccatccatataatact

SEQ ID NO: 303003 - DNA, 20 bp, Artificial Sequence
  Description of Artificial Sequence: Synthetic oligonucleotide
  Target: ATXN1; (+) strand; PAM type: YTN; PAM sequence: TTC
agcccatccatataatacta

SEQ ID NO: 303004 - DNA, 20 bp, Artificial Sequence
  Description of Artificial Sequence: Synthetic oligonucleotide
  Target: ATXN1; (+) strand; PAM type: YTN; PAM sequence: CTA
ttttgcacttcttttgtctt

SEQ ID NO: 303005 - DNA, 20 bp, Artificial Sequence
  Description of Artificial Sequence: Synthetic oligonucleotide
  Target: ATXN1; (+) strand; PAM type: YTN; PAM sequence: TTT
tgcacttcttttgtctttct

SEQ ID NO: 303006 - DNA, 20 bp, Artificial Sequence
  Description of Artificial Sequence: Synthetic oligonucleotide
  Target: ATXN1; (+) strand; PAM type: YTN; PAM sequence: TTT
gcacttcttttgtctttctt

SEQ ID NO: 303007 - DNA, 20 bp, Artificial Sequence
  Description of Artificial Sequence: Synthetic oligonucleotide
  Target: ATXN1; (+) strand; PAM type: YTN; PAM sequence: TTG
cacttcttttgtctttcttt

SEQ ID NO: 303008 - DNA, 20 bp, Artificial Sequence
  Description of Artificial Sequence: Synthetic oligonucleotide
  Target: ATXN1; (+) strand; PAM type: YTN; PAM sequence: CTT
cttttgtctttctttgccca

SEQ ID NO: 303009 - DNA, 20 bp, Artificial Sequence
  Description of Artificial Sequence: Synthetic oligonucleotide
  Target: ATXN1; (+) strand; PAM type: YTN; PAM sequence: TTC
ttttgtctttctttgcccaa

SEQ ID NO: 303010 - DNA, 20 bp, Artificial Sequence
  Description of Artificial Sequence: Synthetic oligonucleotide
  Target: ATXN1; (+) strand; PAM type: YTN; PAM sequence: CTT
ttgtctttctttgcccaagc

SEQ ID NO: 303011 - DNA, 20 bp, Artificial Sequence
  Description of Artificial Sequence: Synthetic oligonucleotide
  Target: ATXN1; (+) strand; PAM type: YTN; PAM sequence: TTT
tgtctttctttgcccaagct

SEQ ID NO: 303012 - DNA, 20 bp, Artificial Sequence
  Description of Artificial Sequence: Synthetic oligonucleotide
  Target: ATXN1; (+) strand; PAM type: YTN; PAM sequence: TTT
gtctttctttgcccaagctt

SEQ ID NO: 303013 - DNA, 20 bp, Artificial Sequence
  Description of Artificial Sequence: Synthetic oligonucleotide
  Target: ATXN1; (+) strand; PAM type: YTN; PAM sequence: TTG
tctttctttgcccaagcttg

SEQ ID NO: 303014 - DNA, 20 bp, Artificial Sequence
  Description of Artificial Sequence: Synthetic oligonucleotide
  Target: ATXN1; (+) strand; PAM type: YTN; PAM sequence: CTT
tctttgcccaagcttgtctg

SEQ ID NO: 303015 - DNA, 20 bp, Artificial Sequence
  Description of Artificial Sequence: Synthetic oligonucleotide
  Target: ATXN1; (+) strand; PAM type: YTN; PAM sequence: TTT
ctttgcccaagcttgtctga

SEQ ID NO: 303016 - DNA, 20 bp, Artificial Sequence
  Description of Artificial Sequence: Synthetic oligonucleotide
  Target: ATXN1; (+) strand; PAM type: YTN; PAM sequence: TTC
tttgcccaagcttgtctgaa

SEQ ID NO: 303017 - DNA, 20 bp, Artificial Sequence
  Description of Artificial Sequence: Synthetic oligonucleotide
  Target: ATXN1; (+) strand; PAM type: YTN; PAM sequence: CTT
tgcccaagcttgtctgaaca

SEQ ID NO: 303018 - DNA, 20 bp, Artificial Sequence
  Description of Artificial Sequence: Synthetic oligonucleotide
  Target: ATXN1; (+) strand; PAM type: YTN; PAM sequence: TTT
gcccaagcttgtctgaacaa

SEQ ID NO: 303019 - DNA, 20 bp, Artificial Sequence
  Description of Artificial Sequence: Synthetic oligonucleotide
  Target: ATXN1; (+) strand; PAM type: YTN; PAM sequence: TTG
cccaagcttgtctgaacaac

SEQ ID NO: 303020 - DNA, 20 bp, Artificial Sequence
  Description of Artificial Sequence: Synthetic oligonucleotide
  Target: ATXN1; (+) strand; PAM type: YTN; PAM sequence: CTT
gtctgaacaactcctcattc

SEQ ID NO: 303021 - DNA, 20 bp, Artificial Sequence
  Description of Artificial Sequence: Synthetic oligonucleotide
  Target: ATXN1; (+) strand; PAM type: YTN; PAM sequence: TTG
tctgaacaactcctcattct

SEQ ID NO: 303022 - DNA, 20 bp, Artificial Sequence
  Description of Artificial Sequence: Synthetic oligonucleotide
  Target: ATXN1; (+) strand; PAM type: YTN; PAM sequence: CTG
aacaactcctcattctgaaa

SEQ ID NO: 303023 - DNA, 20 bp, Artificial Sequence
  Description of Artificial Sequence: Synthetic oligonucleotide
  Target: ATXN1; (+) strand; PAM type: YTN; PAM sequence: CTC
ctcattctgaaaagcttgga

SEQ ID NO: 303024 - DNA, 20 bp, Artificial Sequence
  Description of Artificial Sequence: Synthetic oligonucleotide
  Target: ATXN1; (+) strand; PAM type: YTN; PAM sequence: CTC
attctgaaaagcttggactg

SEQ ID NO: 303025 - DNA, 20 bp, Artificial Sequence
  Description of Artificial Sequence: Synthetic oligonucleotide
  Target: ATXN1; (+) strand; PAM type: YTN; PAM sequence: TTC
tgaaaagcttggactgaagg

SEQ ID NO: 303026 - DNA, 20 bp, Artificial Sequence
  Description of Artificial Sequence: Synthetic oligonucleotide
  Target: ATXN1; (+) strand; PAM type: YTN; PAM sequence: CTG
aaaagcttggactgaaggac

SEQ ID NO: 303027 - DNA, 20 bp, Artificial Sequence
  Description of Artificial Sequence: Synthetic oligonucleotide
  Target: ATXN1; (+) strand; PAM type: YTN; PAM sequence: CTT
ggactgaaggacgtgctctg

SEQ ID NO: 303028 - DNA, 20 bp, Artificial Sequence
  Description of Artificial Sequence: Synthetic oligonucleotide
  Target: ATXN1; (+) strand; PAM type: YTN; PAM sequence: TTG
gactgaaggacgtgctctgc

SEQ ID NO: 303029 - DNA, 20 bp, Artificial Sequence
  Description of Artificial Sequence: Synthetic oligonucleotide
  Target: ATXN1; (+) strand; PAM type: YTN; PAM sequence: CTG
aaggacgtgctctgcaggcc

SEQ ID NO: 303030 - DNA, 20 bp, Artificial Sequence
  Description of Artificial Sequence: Synthetic oligonucleotide
  Target: ATXN1; (+) strand; PAM type: YTN; PAM sequence: CTC
tgcaggccttctcagcaccc

SEQ ID NO: 303031 - DNA, 20 bp, Artificial Sequence
  Description of Artificial Sequence: Synthetic oligonucleotide
  Target: ATXN1; (+) strand; PAM type: YTN; PAM sequence: CTG
caggccttctcagcaccctt

SEQ ID NO: 303032 - DNA, 20 bp, Artificial Sequence
  Description of Artificial Sequence: Synthetic oligonucleotide
  Target: ATXN1; (+) strand; PAM type: YTN; PAM sequence: CTT
ctcagcaccctttcctccag

SEQ ID NO: 303033 - DNA, 20 bp, Artificial Sequence
  Description of Artificial Sequence: Synthetic oligonucleotide
  Target: ATXN1; (+) strand; PAM type: YTN; PAM sequence: TTC
tcagcaccctttcctccagt

SEQ ID NO: 303034 - DNA, 20 bp, Artificial Sequence
  Description of Artificial Sequence: Synthetic oligonucleotide
  Target: ATXN1; (+) strand; PAM type: YTN; PAM sequence: CTC
agcaccctttcctccagtca

SEQ ID NO: 303035 - DNA, 20 bp, Artificial Sequence
  Description of Artificial Sequence: Synthetic oligonucleotide
  Target: ATXN1; (+) strand; PAM type: YTN; PAM sequence: CTT
tcctccagtcaacctgactc

SEQ ID NO: 303036 - DNA, 20 bp, Artificial Sequence
  Description of Artificial Sequence: Synthetic oligonucleotide
  Target: ATXN1; (+) strand; PAM type: YTN; PAM sequence: TTT
cctccagtcaacctgactca

SEQ ID NO: 303037 - DNA, 20 bp, Artificial Sequence
  Description of Artificial Sequence: Synthetic oligonucleotide
  Target: ATXN1; (+) strand; PAM type: YTN; PAM sequence: TTC
ctccagtcaacctgactcag

SEQ ID NO: 303038 - DNA, 20 bp, Artificial Sequence
  Description of Artificial Sequence: Synthetic oligonucleotide
  Target: ATXN1; (+) strand; PAM type: YTN; PAM sequence: CTC
cagtcaacctgactcaggta

SEQ ID NO: 303039 - DNA, 20 bp, Artificial Sequence
  Description of Artificial Sequence: Synthetic oligonucleotide
  Target: ATXN1; (+) strand; PAM type: YTN; PAM sequence: CTG
actcaggtatgaaacatacc

SEQ ID NO: 303040 - DNA, 20 bp, Artificial Sequence
  Description of Artificial Sequence: Synthetic oligonucleotide
  Target: ATXN1; (+) strand; PAM type: YTN; PAM sequence: CTC
aggtatgaaacataccctac

SEQ ID NO: 303041 - DNA, 20 bp, Artificial Sequence
  Description of Artificial Sequence: Synthetic oligonucleotide
  Target: ATXN1; (+) strand; PAM type: YTN; PAM sequence: CTA
ccataatgcttaacagagag

SEQ ID NO: 303042 - DNA, 20 bp, Artificial Sequence
  Description of Artificial Sequence: Synthetic oligonucleotide
  Target: ATXN1; (+) strand; PAM type: YTN; PAM sequence: CTT
aacagagagcaatgattaat

SEQ ID NO: 303043 - DNA, 20 bp, Artificial Sequence
  Description of Artificial Sequence: Synthetic oligonucleotide
  Target: ATXN1; (+) strand; PAM type: YTN; PAM sequence: TTA
acagagagcaatgattaatc

SEQ ID NO: 303044 - DNA, 20 bp, Artificial Sequence
  Description of Artificial Sequence: Synthetic oligonucleotide
  Target: ATXN1; (+) strand; PAM type: YTN; PAM sequence: TTA
atctgttgcctgctcccagt

SEQ ID NO: 303045 - DNA, 20 bp, Artificial Sequence
  Description of Artificial Sequence: Synthetic oligonucleotide
  Target: ATXN1; (+) strand; PAM type: YTN; PAM sequence: CTG
ttgcctgctcccagtactag

SEQ ID NO: 303046 - DNA, 20 bp, Artificial Sequence
  Description of Artificial Sequence: Synthetic oligonucleotide
  Target: ATXN1; (+) strand; PAM type: YTN; PAM sequence: TTG
cctgctcccagtactagagg

SEQ ID NO: 303047 - DNA, 20 bp, Artificial Sequence
  Description of Artificial Sequence: Synthetic oligonucleotide
  Target: ATXN1; (+) strand; PAM type: YTN; PAM sequence: CTG
ctcccagtactagaggtcaa

SEQ ID NO: 303048 - DNA, 20 bp, Artificial Sequence
  Description of Artificial Sequence: Synthetic oligonucleotide
  Target: ATXN1; (+) strand; PAM type: YTN; PAM sequence: CTC
ccagtactagaggtcaaaga

SEQ ID NO: 303049 - DNA, 20 bp, Artificial Sequence
  Description of Artificial Sequence: Synthetic oligonucleotide
  Target: ATXN1; (+) strand; PAM type: YTN; PAM sequence: CTA
gaggtcaaagaccacatcct

SEQ ID NO: 303050 - DNA, 20 bp, Artificial Sequence
  Description of Artificial Sequence: Synthetic oligonucleotide
  Target: ATXN1; (+) strand; PAM type: YTN; PAM sequence: CTA
tcttatgctttagcctcaat

SEQ ID NO: 303051 - DNA, 20 bp, Artificial Sequence
  Description of Artificial Sequence: Synthetic oligonucleotide
  Target: ATXN1; (+) strand; PAM type: YTN; PAM sequence: CTT
atgctttagcctcaatacct

SEQ ID NO: 303052 - DNA, 20 bp, Artificial Sequence
  Description of Artificial Sequence: Synthetic oligonucleotide
  Target: ATXN1; (+) strand; PAM type: YTN; PAM sequence: TTA
tgctttagcctcaataccta

SEQ ID NO: 303053 - DNA, 20 bp, Artificial Sequence
  Description of Artificial Sequence: Synthetic oligonucleotide
  Target: ATXN1; (+) strand; PAM type: YTN; PAM sequence: CTT
tagcctcaatacctagagca

SEQ ID NO: 303054 - DNA, 20 bp, Artificial Sequence
  Description of Artificial Sequence: Synthetic oligonucleotide
  Target: ATXN1; (+) strand; PAM type: YTN; PAM sequence: TTT
agcctcaatacctagagcag

SEQ ID NO: 303055 - DNA, 20 bp, Artificial Sequence
  Description of Artificial Sequence: Synthetic oligonucleotide
  Target: ATXN1; (+) strand; PAM type: YTN; PAM sequence: TTA
gcctcaatacctagagcaga

SEQ ID NO: 303056 - DNA, 20 bp, Artificial Sequence
  Description of Artificial Sequence: Synthetic oligonucleotide
  Target: ATXN1; (+) strand; PAM type: YTN; PAM sequence: CTC
aatacctagagcagaatttg

SEQ ID NO: 303057 - DNA, 20 bp, Artificial Sequence
  Description of Artificial Sequence: Synthetic oligonucleotide
  Target: ATXN1; (+) strand; PAM type: YTN; PAM sequence: CTA
gagcagaatttggcgcccaa

SEQ ID NO: 303058 - DNA, 20 bp, Artificial Sequence
  Description of Artificial Sequence: Synthetic oligonucleotide
  Target: ATXN1; (+) strand; PAM type: YTN; PAM sequence: TTT
ggcgcccaatacgtatgcaa

SEQ ID NO: 303059 - DNA, 20 bp, Artificial Sequence
  Description of Artificial Sequence: Synthetic oligonucleotide
  Target: ATXN1; (+) strand; PAM type: YTN; PAM sequence: TTG
gcgcccaatacgtatgcaag

SEQ ID NO: 303060 - DNA, 20 bp, Artificial Sequence
  Description of Artificial Sequence: Synthetic oligonucleotide
  Target: ATXN1; (+) strand; PAM type: YTN; PAM sequence: CTT
tgttgaattaatgaagaatg

SEQ ID NO: 303061 - DNA, 20 bp, Artificial Sequence
  Description of Artificial Sequence: Synthetic oligonucleotide
  Target: ATXN1; (+) strand; PAM type: YTN; PAM sequence: TTT
gttgaattaatgaagaatgg

SEQ ID NO: 303062 - DNA, 20 bp, Artificial Sequence
  Description of Artificial Sequence: Synthetic oligonucleotide
  Target: ATXN1; (+) strand; PAM type: YTN; PAM sequence: TTG
ttgaattaatgaagaatgga

SEQ ID NO: 303063 - DNA, 20 bp, Artificial Sequence
  Description of Artificial Sequence: Synthetic oligonucleotide
  Target: ATXN1; (+) strand; PAM type: YTN; PAM sequence: TTG
aattaatgaagaatggagaa

SEQ ID NO: 303064 - DNA, 20 bp, Artificial Sequence
  Description of Artificial Sequence: Synthetic oligonucleotide
  Target: ATXN1; (+) strand; PAM type: YTN; PAM sequence: TTA
atgaagaatggagaaagaga

SEQ ID NO: 303065 - DNA, 20 bp, Artificial Sequence
  Description of Artificial Sequence: Synthetic oligonucleotide
  Target: ATXN1; (+) strand; PAM type: YTN; PAM sequence: CTT
aaaggaagagagggccgggc

SEQ ID NO: 303066 - DNA, 20 bp, Artificial Sequence
  Description of Artificial Sequence: Synthetic oligonucleotide
  Target: ATXN1; (+) strand; PAM type: YTN; PAM sequence: TTA
aaggaagagagggccgggca

SEQ ID NO: 303067 - DNA, 20 bp, Artificial Sequence
  Description of Artificial Sequence: Synthetic oligonucleotide
  Target: ATXN1; (+) strand; PAM type: YTN; PAM sequence: CTT
atgcctgtaatcccagcact

SEQ ID NO: 303068 - DNA, 20 bp, Artificial Sequence
  Description of Artificial Sequence: Synthetic oligonucleotide
  Target: ATXN1; (+) strand; PAM type: YTN; PAM sequence: TTA
tgcctgtaatcccagcactt

SEQ ID NO: 303069 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 303070 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcaagtgg

SEQ ID NO: 303071 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcaagtgga

SEQ ID NO: 303072 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcaagtggat

SEQ ID NO: 303073 - DNA, 20 bp, Artificial Sequence
  Description of Artificial Sequence: Synthetic oligonucleotide
  Target: ATXN1; (+) strand; PAM type: YTN; PAM sequence: TTC
aagaccatcctgaccaacaa

SEQ ID NO: 303074 - DNA, 20 bp, Artificial Sequence
  Description of Artificial Sequence: Synthetic oligonucleotide
  Target: ATXN1; (+) strand; PAM type: YTN; PAM sequence: CTG
accaacaaggtgaaaccctg

SEQ ID NO: 303075 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaacacaaaa

SEQ ID NO: 303076 - DNA, 20 bp, Artificial Sequence
  Description of Artificial Sequence: Synthetic oligonucleotide
  Target: ATXN1; (+) strand; PAM type: YTN; PAM sequence: CTC
tactaaaaacacaaaaaaat

SEQ ID NO: 303077 - DNA, 20 bp, Artificial Sequence
  Description of Artificial Sequence: Synthetic oligonucleotide
  Target: ATXN1; (+) strand; PAM type: YTN; PAM sequence: CTA
ctaaaaacacaaaaaaatgg

SEQ ID NO: 303078 - DNA, 20 bp, Artificial Sequence
  Description of Artificial Sequence: Synthetic oligonucleotide
  Target: ATXN1; (+) strand; PAM type: YTN; PAM sequence: CTA
aaaacacaaaaaaatggtcc

SEQ ID NO: 303079 - DNA, 20 bp, Artificial Sequence
  Description of Artificial Sequence: Synthetic oligonucleotide
  Target: ATXN1; (+) strand; PAM type: YTN; PAM sequence: CTT
gtaatcctagctactcagga

SEQ ID NO: 303080 - DNA, 20 bp, Artificial Sequence
  Description of Artificial Sequence: Synthetic oligonucleotide
  Target: ATXN1; (+) strand; PAM type: YTN; PAM sequence: TTG
taatcctagctactcaggag

SEQ ID NO: 303081 - DNA, 20 bp, Artificial Sequence
  Description of Artificial Sequence: Synthetic oligonucleotide
  Target: ATXN1; (+) strand; PAM type: YTN; PAM sequence: CTA
gctactcaggagactgaggc

SEQ ID NO: 303082 - DNA, 20 bp, Artificial Sequence
  Description of Artificial Sequence: Synthetic oligonucleotide
  Target: ATXN1; (+) strand; PAM type: YTN; PAM sequence: CTA
ctcaggagactgaggcagga

SEQ ID NO: 303083 - DNA, 20 bp, Artificial Sequence
  Description of Artificial Sequence: Synthetic oligonucleotide
  Target: ATXN1; (+) strand; PAM type: YTN; PAM sequence: CTC
aggagactgaggcaggagaa

SEQ ID NO: 303084 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttgaa

SEQ ID NO: 303085 - DNA, 20 bp, Artificial Sequence
  Description of Artificial Sequence: Synthetic oligonucleotide
  Target: ATXN1; (+) strand; PAM type: YTN; PAM sequence: TTG
cttgaacccagaggcggaag

SEQ ID NO: 303086 - DNA, 20 bp, Artificial Sequence
  Description of Artificial Sequence: Synthetic oligonucleotide
  Target: ATXN1; (+) strand; PAM type: YTN; PAM sequence: CTT
gaacccagaggcggaagttg

SEQ ID NO: 303087 - DNA, 20 bp, Artificial Sequence
  Description of Artificial Sequence: Synthetic oligonucleotide
  Target: ATXN1; (+) strand; PAM type: YTN; PAM sequence: TTG
aacccagaggcggaagttgc

SEQ ID NO: 303088 - DNA, 20 bp, Artificial Sequence
  Description of Artificial Sequence: Synthetic oligonucleotide
  Target: ATXN1; (+) strand; PAM type: YTN; PAM sequence: TTG
cagggagccgagattgcacc

SEQ ID NO: 303089 - DNA, 20 bp, Artificial Sequence
  Description of Artificial Sequence: Synthetic oligonucleotide
  Target: ATXN1; (+) strand; PAM type: YTN; PAM sequence: TTG
caccattgcgctccagcctg

SEQ ID NO: 303090 - DNA, 20 bp, Artificial Sequence
  Description of Artificial Sequence: Synthetic oligonucleotide
  Target: ATXN1; (+) strand; PAM type: YTN; PAM sequence: TTG
cgctccagcctgggcgacag

SEQ ID NO: 303091 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacagagcaa

SEQ ID NO: 303092 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagcaagactcca

SEQ ID NO: 303093 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaaaaaaaaaaa

SEQ ID NO: 303094 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaagga

SEQ ID NO: 303095 - DNA, 20 bp, Artificial Sequence
  Description of Artificial Sequence: Synthetic oligonucleotide
  Target: ATXN1; (+) strand; PAM type: YTN; PAM sequence: CTG
agagggttaagtgctttatt

SEQ ID NO: 303096 - DNA, 20 bp, Artificial Sequence
  Description of Artificial Sequence: Synthetic oligonucleotide
  Target: ATXN1; (+) strand; PAM type: YTN; PAM sequence: TTA
agtgctttattcagggctaa

SEQ ID NO: 303097 - DNA, 20 bp, Artificial Sequence
  Description of Artificial Sequence: Synthetic oligonucleotide
  Target: ATXN1; (+) strand; PAM type: YTN; PAM sequence: CTT
tattcagggctaaataaacc

SEQ ID NO: 303098 - DNA, 20 bp, Artificial Sequence
  Description of Artificial Sequence: Synthetic oligonucleotide
  Target: ATXN1; (+) strand; PAM type: YTN; PAM sequence: TTT
attcagggctaaataaacca

SEQ ID NO: 303099 - DNA, 20 bp, Artificial Sequence
  Description of Artificial Sequence: Synthetic oligonucleotide
  Target: ATXN1; (+) strand; PAM type: YTN; PAM sequence: TTA
ttcagggctaaataaaccag

SEQ ID NO: 303100 - DNA, 20 bp, Artificial Sequence
  Description of Artificial Sequence: Synthetic oligonucleotide
  Target: ATXN1; (+) strand; PAM type: YTN; PAM sequence: TTC
agggctaaataaaccagact

SEQ ID NO: 303101 - DNA, 20 bp, Artificial Sequence
  Description of Artificial Sequence: Synthetic oligonucleotide
  Target: ATXN1; (+) strand; PAM type: YTN; PAM sequence: CTA
aataaaccagactgggacaa

SEQ ID NO: 303102 - DNA, 20 bp, Artificial Sequence
  Description of Artificial Sequence: Synthetic oligonucleotide
  Target: ATXN1; (+) strand; PAM type: YTN; PAM sequence: CTG
ggacaagaattcaggcctcc

SEQ ID NO: 303103 - DNA, 20 bp, Artificial Sequence
  Description of Artificial Sequence: Synthetic oligonucleotide
  Target: ATXN1; (+) strand; PAM type: YTN; PAM sequence: TTC
aggcctcctaactttctctg

SEQ ID NO: 303104 - DNA, 20 bp, Artificial Sequence
  Description of Artificial Sequence: Synthetic oligonucleotide
  Target: ATXN1; (+) strand; PAM type: YTN; PAM sequence: CTC
ctaactttctctgatggatc

SEQ ID NO: 303105 - DNA, 20 bp, Artificial Sequence
  Description of Artificial Sequence: Synthetic oligonucleotide
  Target: ATXN1; (+) strand; PAM type: YTN; PAM sequence: CTA
actttctctgatggatcctc

SEQ ID NO: 303106 - DNA, 20 bp, Artificial Sequence
  Description of Artificial Sequence: Synthetic oligonucleotide
  Target: ATXN1; (+) strand; PAM type: YTN; PAM sequence: CTT
tctctgatggatcctccttc

SEQ ID NO: 303107 - DNA, 20 bp, Artificial Sequence
  Description of Artificial Sequence: Synthetic oligonucleotide
  Target: ATXN1; (+) strand; PAM type: YTN; PAM sequence: TTT
ctctgatggatcctccttct

SEQ ID NO: 303108 - DNA, 20 bp, Artificial Sequence
  Description of Artificial Sequence: Synthetic oligonucleotide
  Target: ATXN1; (+) strand; PAM type: YTN; PAM sequence: TTC
tctgatggatcctccttctt

SEQ ID NO: 303109 - DNA, 20 bp, Artificial Sequence
  Description of Artificial Sequence: Synthetic oligonucleotide
  Target: ATXN1; (+) strand; PAM type: YTN; PAM sequence: CTC
tgatggatcctccttcttcc

SEQ ID NO: 303110 - DNA, 20 bp, Artificial Sequence
  Description of Artificial Sequence: Synthetic oligonucleotide
  Target: ATXN1; (+) strand; PAM type: YTN; PAM sequence: CTG
atggatcctccttcttccaa

SEQ ID NO: 303111 - DNA, 20 bp, Artificial Sequence
  Description of Artificial Sequence: Synthetic oligonucleotide
  Target: ATXN1; (+) strand; PAM type: YTN; PAM sequence: CTC
cttcttccaatccatcccat

SEQ ID NO: 303112 - DNA, 20 bp, Artificial Sequence
  Description of Artificial Sequence: Synthetic oligonucleotide
  Target: ATXN1; (+) strand; PAM type: YTN; PAM sequence: CTT
cttccaatccatcccataaa

SEQ ID NO: 303113 - DNA, 20 bp, Artificial Sequence
  Description of Artificial Sequence: Synthetic oligonucleotide
  Target: ATXN1; (+) strand; PAM type: YTN; PAM sequence: TTC
ttccaatccatcccataaat

SEQ ID NO: 303114 - DNA, 20 bp, Artificial Sequence
  Description of Artificial Sequence: Synthetic oligonucleotide
  Target: ATXN1; (+) strand; PAM type: YTN; PAM sequence: CTT
ccaatccatcccataaatgc

SEQ ID NO: 303115 - DNA, 20 bp, Artificial Sequence
  Description of Artificial Sequence: Synthetic oligonucleotide
  Target: ATXN1; (+) strand; PAM type: YTN; PAM sequence: TTC
caatccatcccataaatgct

SEQ ID NO: 303116 - DNA, 20 bp, Artificial Sequence
  Description of Artificial Sequence: Synthetic oligonucleotide
  Target: ATXN1; (+) strand; PAM type: YTN; PAM sequence: CTT
ttcaaatttctcttctcttc

SEQ ID NO: 303117 - DNA, 20 bp, Artificial Sequence
  Description of Artificial Sequence: Synthetic oligonucleotide
  Target: ATXN1; (+) strand; PAM type: YTN; PAM sequence: TTT
tcaaatttctcttctcttca

SEQ ID NO: 303118 - DNA, 20 bp, Artificial Sequence
  Description of Artificial Sequence: Synthetic oligonucleotide
  Target: ATXN1; (+) strand; PAM type: YTN; PAM sequence: TTT
caaatttctcttctcttcac

SEQ ID NO: 303119 - DNA, 20 bp, Artificial Sequence
  Description of Artificial Sequence: Synthetic oligonucleotide
  Target: ATXN1; (+) strand; PAM type: YTN; PAM sequence: TTC
aaatttctcttctcttcact

SEQ ID NO: 303120 - DNA, 20 bp, Artificial Sequence
  Description of Artificial Sequence: Synthetic oligonucleotide
  Target: ATXN1; (+) strand; PAM type: YTN; PAM sequence: TTT
ctcttctcttcactttatca

SEQ ID NO: 303121 - DNA, 20 bp, Artificial Sequence
  Description of Artificial Sequence: Synthetic oligonucleotide
  Target: ATXN1; (+) strand; PAM type: YTN; PAM sequence: TTC
tcttctcttcactttatcac

SEQ ID NO: 303122 - DNA, 20 bp, Artificial Sequence
  Description of Artificial Sequence: Synthetic oligonucleotide
  Target: ATXN1; (+) strand; PAM type: YTN; PAM sequence: CTC
ttctcttcactttatcacct

SEQ ID NO: 303123 - DNA, 20 bp, Artificial Sequence
  Description of Artificial Sequence: Synthetic oligonucleotide
  Target: ATXN1; (+) strand; PAM type: YTN; PAM sequence: CTT
ctcttcactttatcacctcc

SEQ ID NO: 303124 - DNA, 20 bp, Artificial Sequence
  Description of Artificial Sequence: Synthetic oligonucleotide
  Target: ATXN1; (+) strand; PAM type: YTN; PAM sequence: TTC
tcttcactttatcacctccc

SEQ ID NO: 303125 - DNA, 20 bp, Artificial Sequence
  Description of Artificial Sequence: Synthetic oligonucleotide
  Target: ATXN1; (+) strand; PAM type: YTN; PAM sequence: CTC
ttcactttatcacctcccgc

SEQ ID NO: 303126 - DNA, 20 bp, Artificial Sequence
  Description of Artificial Sequence: Synthetic oligonucleotide
  Target: ATXN1; (+) strand; PAM type: YTN; PAM sequence: CTT
cactttatcacctcccgcta

SEQ ID NO: 303127 - DNA, 20 bp, Artificial Sequence
  Description of Artificial Sequence: Synthetic oligonucleotide
  Target: ATXN1; (+) strand; PAM type: YTN; PAM sequence: TTC
actttatcacctcccgctag

SEQ ID NO: 303128 - DNA, 20 bp, Artificial Sequence
  Description of Artificial Sequence: Synthetic oligonucleotide
  Target: ATXN1; (+) strand; PAM type: YTN; PAM sequence: CTT
tatcacctcccgctagacga

SEQ ID NO: 303129 - DNA, 20 bp, Artificial Sequence
  Description of Artificial Sequence: Synthetic oligonucleotide
  Target: ATXN1; (+) strand; PAM type: YTN; PAM sequence: TTT
atcacctcccgctagacgag

SEQ ID NO: 303130 - DNA, 20 bp, Artificial Sequence
  Description of Artificial Sequence: Synthetic oligonucleotide
  Target: ATXN1; (+) strand; PAM type: YTN; PAM sequence: TTA
tcacctcccgctagacgagc

SEQ ID NO: 303131 - DNA, 20 bp, Artificial Sequence
  Description of Artificial Sequence: Synthetic oligonucleotide
  Target: ATXN1; (+) strand; PAM type: YTN; PAM sequence: CTC
ccgctagacgagcttctaca

SEQ ID NO: 303132 - DNA, 20 bp, Artificial Sequence
  Description of Artificial Sequence: Synthetic oligonucleotide
  Target: ATXN1; (+) strand; PAM type: YTN; PAM sequence: CTA
gacgagcttctacagttttc

SEQ ID NO: 303133 - DNA, 20 bp, Artificial Sequence
  Description of Artificial Sequence: Synthetic oligonucleotide
  Target: ATXN1; (+) strand; PAM type: YTN; PAM sequence: CTT
ctacagttttcctaacagct

SEQ ID NO: 303134 - DNA, 20 bp, Artificial Sequence
  Description of Artificial Sequence: Synthetic oligonucleotide
  Target: ATXN1; (+) strand; PAM type: YTN; PAM sequence: TTC
tacagttttcctaacagcta

SEQ ID NO: 303135 - DNA, 20 bp, Artificial Sequence
  Description of Artificial Sequence: Synthetic oligonucleotide
  Target: ATXN1; (+) strand; PAM type: YTN; PAM sequence: CTA
cagttttcctaacagctatt

SEQ ID NO: 303136 - DNA, 20 bp, Artificial Sequence
  Description of Artificial Sequence: Synthetic oligonucleotide
  Target: ATXN1; (+) strand; PAM type: YTN; PAM sequence: TTT
tcctaacagctattgaatct

SEQ ID NO: 303137 - DNA, 20 bp, Artificial Sequence
  Description of Artificial Sequence: Synthetic oligonucleotide
  Target: ATXN1; (+) strand; PAM type: YTN; PAM sequence: TTT
cctaacagctattgaatctc

SEQ ID NO: 303138 - DNA, 20 bp, Artificial Sequence
  Description of Artificial Sequence: Synthetic oligonucleotide
  Target: ATXN1; (+) strand; PAM type: YTN; PAM sequence: TTC
ctaacagctattgaatctct

SEQ ID NO: 303139 - DNA, 20 bp, Artificial Sequence
  Description of Artificial Sequence: Synthetic oligonucleotide
  Target: ATXN1; (+) strand; PAM type: YTN; PAM sequence: CTA
acagctattgaatctctatc

SEQ ID NO: 303140 - DNA, 20 bp, Artificial Sequence
  Description of Artificial Sequence: Synthetic oligonucleotide
  Target: ATXN1; (+) strand; PAM type: YTN; PAM sequence: CTA
ttgaatctctatcatctctt

SEQ ID NO: 303141 - DNA, 20 bp, Artificial Sequence
  Description of Artificial Sequence: Synthetic oligonucleotide
  Target: ATXN1; (+) strand; PAM type: YTN; PAM sequence: TTG
aatctctatcatctcttttc

SEQ ID NO: 303142 - DNA, 20 bp, Artificial Sequence
  Description of Artificial Sequence: Synthetic oligonucleotide
  Target: ATXN1; (+) strand; PAM type: YTN; PAM sequence: CTC
tatcatctcttttcaatcct

SEQ ID NO: 303143 - DNA, 20 bp, Artificial Sequence
  Description of Artificial Sequence: Synthetic oligonucleotide
  Target: ATXN1; (+) strand; PAM type: YTN; PAM sequence: CTA
tcatctcttttcaatcctag

SEQ ID NO: 303144 - DNA, 20 bp, Artificial Sequence
  Description of Artificial Sequence: Synthetic oligonucleotide
  Target: ATXN1; (+) strand; PAM type: YTN; PAM sequence: CTC
ttttcaatcctagacttaga

SEQ ID NO: 303145 - DNA, 20 bp, Artificial Sequence
  Description of Artificial Sequence: Synthetic oligonucleotide
  Target: ATXN1; (+) strand; PAM type: YTN; PAM sequence: CTT
ttcaatcctagacttagata

SEQ ID NO: 303146 - DNA, 20 bp, Artificial Sequence
  Description of Artificial Sequence: Synthetic oligonucleotide
  Target: ATXN1; (+) strand; PAM type: YTN; PAM sequence: TTT
tcaatcctagacttagatat

SEQ ID NO: 303147 - DNA, 20 bp, Artificial Sequence
  Description of Artificial Sequence: Synthetic oligonucleotide
  Target: ATXN1; (+) strand; PAM type: YTN; PAM sequence: TTT
caatcctagacttagatata

SEQ ID NO: 303148 - DNA, 20 bp, Artificial Sequence
  Description of Artificial Sequence: Synthetic oligonucleotide
  Target: ATXN1; (+) strand; PAM type: YTN; PAM sequence: TTC
aatcctagacttagatatac

SEQ ID NO: 303149 - DNA, 20 bp, Artificial Sequence
  Description of Artificial Sequence: Synthetic oligonucleotide
  Target: ATXN1; (+) strand; PAM type: YTN; PAM sequence: CTA
gacttagatatacaattttc

SEQ ID NO: 303150 - DNA, 20 bp, Artificial Sequence
  Description of Artificial Sequence: Synthetic oligonucleotide
  Target: ATXN1; (+) strand; PAM type: YTN; PAM sequence: CTT
agatatacaattttctgtca

SEQ ID NO: 303151 - DNA, 20 bp, Artificial Sequence
  Description of Artificial Sequence: Synthetic oligonucleotide
  Target: ATXN1; (+) strand; PAM type: YTN; PAM sequence: TTA
gatatacaattttctgtcac

SEQ ID NO: 303152 - DNA, 20 bp, Artificial Sequence
  Description of Artificial Sequence: Synthetic oligonucleotide
  Target: ATXN1; (+) strand; PAM type: YTN; PAM sequence: TTT
tctgtcacctaaatgtctca

SEQ ID NO: 303153 - DNA, 20 bp, Artificial Sequence
  Description of Artificial Sequence: Synthetic oligonucleotide
  Target: ATXN1; (+) strand; PAM type: YTN; PAM sequence: TTT
ctgtcacctaaatgtctcat

SEQ ID NO: 303154 - DNA, 20 bp, Artificial Sequence
  Description of Artificial Sequence: Synthetic oligonucleotide
  Target: ATXN1; (+) strand; PAM type: YTN; PAM sequence: TTC
tgtcacctaaatgtctcatt

SEQ ID NO: 303155 - DNA, 20 bp, Artificial Sequence
  Description of Artificial Sequence: Synthetic oligonucleotide
  Target: ATXN1; (+) strand; PAM type: YTN; PAM sequence: CTG
tcacctaaatgtctcattgg

SEQ ID NO: 303156 - DNA, 20 bp, Artificial Sequence
  Description of Artificial Sequence: Synthetic oligonucleotide
  Target: ATXN1; (+) strand; PAM type: YTN; PAM sequence: CTA
aatgtctcattggcagctca

SEQ ID NO: 303157 - DNA, 20 bp, Artificial Sequence
  Description of Artificial Sequence: Synthetic oligonucleotide
  Target: ATXN1; (+) strand; PAM type: YTN; PAM sequence: CTC
attggcagctcaaattcaaa

SEQ ID NO: 303158 - DNA, 20 bp, Artificial Sequence
  Description of Artificial Sequence: Synthetic oligonucleotide
  Target: ATXN1; (+) strand; PAM type: YTN; PAM sequence: TTG
gcagctcaaattcaaaagat

SEQ ID NO: 303159 - DNA, 20 bp, Artificial Sequence
  Description of Artificial Sequence: Synthetic oligonucleotide
  Target: ATXN1; (+) strand; PAM type: YTN; PAM sequence: CTC
aaattcaaaagatgaagaaa

SEQ ID NO: 303160 - DNA, 20 bp, Artificial Sequence
  Description of Artificial Sequence: Synthetic oligonucleotide
  Target: ATXN1; (+) strand; PAM type: YTN; PAM sequence: TTC
aaaagatgaagaaatgaaat

SEQ ID NO: 303161 - DNA, 20 bp, Artificial Sequence
  Description of Artificial Sequence: Synthetic oligonucleotide
  Target: ATXN1; (+) strand; PAM type: YTN; PAM sequence: TTA
catttctaaccaccctgcca

SEQ ID NO: 303162 - DNA, 20 bp, Artificial Sequence
  Description of Artificial Sequence: Synthetic oligonucleotide
  Target: ATXN1; (+) strand; PAM type: YTN; PAM sequence: TTT
ctaaccaccctgccaccaag

SEQ ID NO: 303163 - DNA, 20 bp, Artificial Sequence
  Description of Artificial Sequence: Synthetic oligonucleotide
  Target: ATXN1; (+) strand; PAM type: YTN; PAM sequence: TTC
taaccaccctgccaccaaga

SEQ ID NO: 303164 - DNA, 20 bp, Artificial Sequence
  Description of Artificial Sequence: Synthetic oligonucleotide
  Target: ATXN1; (+) strand; PAM type: YTN; PAM sequence: CTA
accaccctgccaccaagaaa

SEQ ID NO: 303165 - DNA, 20 bp, Artificial Sequence
  Description of Artificial Sequence: Synthetic oligonucleotide
  Target: ATXN1; (+) strand; PAM type: YTN; PAM sequence: CTG
ccaccaagaaaaagaagttg

SEQ ID NO: 303166 - DNA, 20 bp, Artificial Sequence
  Description of Artificial Sequence: Synthetic oligonucleotide
  Target: ATXN1; (+) strand; PAM type: YTN; PAM sequence: TTG
ttcctcctcaggaatctgta

SEQ ID NO: 303167 - DNA, 20 bp, Artificial Sequence
  Description of Artificial Sequence: Synthetic oligonucleotide
  Target: ATXN1; (+) strand; PAM type: YTN; PAM sequence: TTC
ctcctcaggaatctgtaggc

SEQ ID NO: 303168 - DNA, 20 bp, Artificial Sequence
  Description of Artificial Sequence: Synthetic oligonucleotide
  Target: ATXN1; (+) strand; PAM type: YTN; PAM sequence: CTC
ctcaggaatctgtaggctcc

SEQ ID NO: 303169 - DNA, 20 bp, Artificial Sequence
  Description of Artificial Sequence: Synthetic oligonucleotide
  Target: ATXN1; (+) strand; PAM type: YTN; PAM sequence: CTC
aggaatctgtaggctcctcc

SEQ ID NO: 303170 - DNA, 20 bp, Artificial Sequence
  Description of Artificial Sequence: Synthetic oligonucleotide
  Target: ATXN1; (+) strand; PAM type: YTN; PAM sequence: CTG
taggctcctcctccccattc

SEQ ID NO: 303171 - DNA, 20 bp, Artificial Sequence
  Description of Artificial Sequence: Synthetic oligonucleotide
  Target: ATXN1; (+) strand; PAM type: YTN; PAM sequence: CTC
ctcctccccattcatacagt

SEQ ID NO: 303172 - DNA, 20 bp, Artificial Sequence
  Description of Artificial Sequence: Synthetic oligonucleotide
  Target: ATXN1; (+) strand; PAM type: YTN; PAM sequence: CTC
ctccccattcatacagtcag

SEQ ID NO: 303173 - DNA, 20 bp, Artificial Sequence
  Description of Artificial Sequence: Synthetic oligonucleotide
  Target: ATXN1; (+) strand; PAM type: YTN; PAM sequence: CTC
cccattcatacagtcagcac

SEQ ID NO: 303174 - DNA, 20 bp, Artificial Sequence
  Description of Artificial Sequence: Synthetic oligonucleotide
  Target: ATXN1; (+) strand; PAM type: YTN; PAM sequence: TTC
atacagtcagcacttgagac

SEQ ID NO: 303175 - DNA, 20 bp, Artificial Sequence
  Description of Artificial Sequence: Synthetic oligonucleotide
  Target: ATXN1; (+) strand; PAM type: YTN; PAM sequence: CTT
gagacagaaatgtggaagct

SEQ ID NO: 303176 - DNA, 20 bp, Artificial Sequence
  Description of Artificial Sequence: Synthetic oligonucleotide
  Target: ATXN1; (+) strand; PAM type: YTN; PAM sequence: TTG
agacagaaatgtggaagcta

SEQ ID NO: 303177 - DNA, 20 bp, Artificial Sequence
  Description of Artificial Sequence: Synthetic oligonucleotide
  Target: ATXN1; (+) strand; PAM type: YTN; PAM sequence: CTA
gcatctattttttttaatta

SEQ ID NO: 303178 - DNA, 20 bp, Artificial Sequence
  Description of Artificial Sequence: Synthetic oligonucleotide
  Target: ATXN1; (+) strand; PAM type: YTN; PAM sequence: CTA
ttttttttaattactatttc

SEQ ID NO: 303179 - DNA, 20 bp, Artificial Sequence
  Description of Artificial Sequence: Synthetic oligonucleotide
  Target: ATXN1; (+) strand; PAM type: YTN; PAM sequence: TTT
tttttaattactatttctat

SEQ ID NO: 303180 - DNA, 20 bp, Artificial Sequence
  Description of Artificial Sequence: Synthetic oligonucleotide
  Target: ATXN1; (+) strand; PAM type: YTN; PAM sequence: TTT
ttttaattactatttctata

SEQ ID NO: 303181 - DNA, 20 bp, Artificial Sequence
  Description of Artificial Sequence: Synthetic oligonucleotide
  Target: ATXN1; (+) strand; PAM type: YTN; PAM sequence: TTT
tttaattactatttctatac

SEQ ID NO: 303182 - DNA, 20 bp, Artificial Sequence
  Description of Artificial Sequence: Synthetic oligonucleotide
  Target: ATXN1; (+) strand; PAM type: YTN; PAM sequence: TTT
ttaattactatttctatact

SEQ ID NO: 303183 - DNA, 20 bp, Artificial Sequence
  Description of Artificial Sequence: Synthetic oligonucleotide
  Target: ATXN1; (+) strand; PAM type: YTN; PAM sequence: TTT
taattactatttctatacta

SEQ ID NO: 303184 - DNA, 20 bp, Artificial Sequence
  Description of Artificial Sequence: Synthetic oligonucleotide
  Target: ATXN1; (+) strand; PAM type: YTN; PAM sequence: TTT
aattactatttctatactag

SEQ ID NO: 303185 - DNA, 20 bp, Artificial Sequence
  Description of Artificial Sequence: Synthetic oligonucleotide
  Target: ATXN1; (+) strand; PAM type: YTN; PAM sequence: TTA
attactatttctatactagg

SEQ ID NO: 303186 - DNA, 20 bp, Artificial Sequence
  Description of Artificial Sequence: Synthetic oligonucleotide
  Target: ATXN1; (+) strand; PAM type: YTN; PAM sequence: TTA
ctatttctatactaggacat

SEQ ID NO: 303187 - DNA, 20 bp, Artificial Sequence
  Description of Artificial Sequence: Synthetic oligonucleotide
  Target: ATXN1; (+) strand; PAM type: YTN; PAM sequence: CTA
tttctatactaggacatata

SEQ ID NO: 303188 - DNA, 20 bp, Artificial Sequence
  Description of Artificial Sequence: Synthetic oligonucleotide
  Target: ATXN1; (+) strand; PAM type: YTN; PAM sequence: TTT
ctatactaggacatatacca

SEQ ID NO: 303189 - DNA, 20 bp, Artificial Sequence
  Description of Artificial Sequence: Synthetic oligonucleotide
  Target: ATXN1; (+) strand; PAM type: YTN; PAM sequence: TTC
tatactaggacatataccat

SEQ ID NO: 303190 - DNA, 20 bp, Artificial Sequence
  Description of Artificial Sequence: Synthetic oligonucleotide
  Target: ATXN1; (+) strand; PAM type: YTN; PAM sequence: CTA
tactaggacatataccatgt

SEQ ID NO: 303191 - DNA, 20 bp, Artificial Sequence
  Description of Artificial Sequence: Synthetic oligonucleotide
  Target: ATXN1; (+) strand; PAM type: YTN; PAM sequence: CTA
ggacatataccatgtgtttt

SEQ ID NO: 303192 - DNA, 20 bp, Artificial Sequence
  Description of Artificial Sequence: Synthetic oligonucleotide
  Target: ATXN1; (+) strand; PAM type: YTN; PAM sequence: TTT
tacatgtcttatttcattta

SEQ ID NO: 303193 - DNA, 20 bp, Artificial Sequence
  Description of Artificial Sequence: Synthetic oligonucleotide
  Target: ATXN1; (+) strand; PAM type: YTN; PAM sequence: TTT
acatgtcttatttcatttaa

SEQ ID NO: 303194 - DNA, 20 bp, Artificial Sequence
  Description of Artificial Sequence: Synthetic oligonucleotide
  Target: ATXN1; (+) strand; PAM type: YTN; PAM sequence: TTA
catgtcttatttcatttaaa

SEQ ID NO: 303195 - DNA, 20 bp, Artificial Sequence
  Description of Artificial Sequence: Synthetic oligonucleotide
  Target: ATXN1; (+) strand; PAM type: YTN; PAM sequence: CTT
atttcatttaaaatggcaga

SEQ ID NO: 303196 - DNA, 20 bp, Artificial Sequence
  Description of Artificial Sequence: Synthetic oligonucleotide
  Target: ATXN1; (+) strand; PAM type: YTN; PAM sequence: TTA
tttcatttaaaatggcagaa

SEQ ID NO: 303197 - DNA, 20 bp, Artificial Sequence
  Description of Artificial Sequence: Synthetic oligonucleotide
  Target: ATXN1; (+) strand; PAM type: YTN; PAM sequence: TTT
catttaaaatggcagaacca

SEQ ID NO: 303198 - DNA, 20 bp, Artificial Sequence
  Description of Artificial Sequence: Synthetic oligonucleotide
  Target: ATXN1; (+) strand; PAM type: YTN; PAM sequence: TTC
atttaaaatggcagaaccaa

SEQ ID NO: 303199 - DNA, 20 bp, Artificial Sequence
  Description of Artificial Sequence: Synthetic oligonucleotide
  Target: ATXN1; (+) strand; PAM type: YTN; PAM sequence: TTT
aaaatggcagaaccaaacct

SEQ ID NO: 303200 - DNA, 20 bp, Artificial Sequence
  Description of Artificial Sequence: Synthetic oligonucleotide
  Target: ATXN1; (+) strand; PAM type: YTN; PAM sequence: TTA
aaatggcagaaccaaacctt

SEQ ID NO: 303201 - DNA, 20 bp, Artificial Sequence
  Description of Artificial Sequence: Synthetic oligonucleotide
  Target: ATXN1; (+) strand; PAM type: YTN; PAM sequence: CTT
ggtaagaagtcatgcaaatg

SEQ ID NO: 303202 - DNA, 20 bp, Artificial Sequence
  Description of Artificial Sequence: Synthetic oligonucleotide
  Target: ATXN1; (+) strand; PAM type: YTN; PAM sequence: TTG
gtaagaagtcatgcaaatgg

SEQ ID NO: 303203 - DNA, 20 bp, Artificial Sequence
  Description of Artificial Sequence: Synthetic oligonucleotide
  Target: ATXN1; (+) strand; PAM type: YTN; PAM sequence: TTT
gggagggaagagaatagggt

SEQ ID NO: 303204 - DNA, 20 bp, Artificial Sequence
  Description of Artificial Sequence: Synthetic oligonucleotide
  Target: ATXN1; (+) strand; PAM type: YTN; PAM sequence: TTG
ggagggaagagaatagggta

SEQ ID NO: 303205 - DNA, 20 bp, Artificial Sequence
  Description of Artificial Sequence: Synthetic oligonucleotide
  Target: ATXN1; (+) strand; PAM type: YTN; PAM sequence: CTG
atatttgccactcatacttg

SEQ ID NO: 303206 - DNA, 20 bp, Artificial Sequence
  Description of Artificial Sequence: Synthetic oligonucleotide
  Target: ATXN1; (+) strand; PAM type: YTN; PAM sequence: TTT
gccactcatacttggcacca

SEQ ID NO: 303207 - DNA, 20 bp, Artificial Sequence
  Description of Artificial Sequence: Synthetic oligonucleotide
  Target: ATXN1; (+) strand; PAM type: YTN; PAM sequence: TTG
ccactcatacttggcaccat

SEQ ID NO: 303208 - DNA, 20 bp, Artificial Sequence
  Description of Artificial Sequence: Synthetic oligonucleotide
  Target: ATXN1; (+) strand; PAM type: YTN; PAM sequence: CTC
atacttggcaccatcaactt

SEQ ID NO: 303209 - DNA, 20 bp, Artificial Sequence
  Description of Artificial Sequence: Synthetic oligonucleotide
  Target: ATXN1; (+) strand; PAM type: YTN; PAM sequence: CTT
ggcaccatcaacttctcttt

SEQ ID NO: 303210 - DNA, 20 bp, Artificial Sequence
  Description of Artificial Sequence: Synthetic oligonucleotide
  Target: ATXN1; (+) strand; PAM type: YTN; PAM sequence: TTG
gcaccatcaacttctctttt

SEQ ID NO: 303211 - DNA, 20 bp, Artificial Sequence
  Description of Artificial Sequence: Synthetic oligonucleotide
  Target: ATXN1; (+) strand; PAM type: YTN; PAM sequence: CTT
ctctttttctcaaactcctc

SEQ ID NO: 303212 - DNA, 20 bp, Artificial Sequence
  Description of Artificial Sequence: Synthetic oligonucleotide
  Target: ATXN1; (+) strand; PAM type: YTN; PAM sequence: TTC
tctttttctcaaactcctca

SEQ ID NO: 303213 - DNA, 20 bp, Artificial Sequence
  Description of Artificial Sequence: Synthetic oligonucleotide
  Target: ATXN1; (+) strand; PAM type: YTN; PAM sequence: CTC
tttttctcaaactcctcaaa

SEQ ID NO: 303214 - DNA, 20 bp, Artificial Sequence
  Description of Artificial Sequence: Synthetic oligonucleotide
  Target: ATXN1; (+) strand; PAM type: YTN; PAM sequence: CTT
tttctcaaactcctcaaata

SEQ ID NO: 303215 - DNA, 20 bp, Artificial Sequence
  Description of Artificial Sequence: Synthetic oligonucleotide
  Target: ATXN1; (+) strand; PAM type: YTN; PAM sequence: TTT
ttctcaaactcctcaaatac

SEQ ID NO: 303216 - DNA, 20 bp, Artificial Sequence
  Description of Artificial Sequence: Synthetic oligonucleotide
  Target: ATXN1; (+) strand; PAM type: YTN; PAM sequence: TTT
tctcaaactcctcaaataca

SEQ ID NO: 303217 - DNA, 20 bp, Artificial Sequence
  Description of Artificial Sequence: Synthetic oligonucleotide
  Target: ATXN1; (+) strand; PAM type: YTN; PAM sequence: TTT
ctcaaactcctcaaatacaa

SEQ ID NO: 303218 - DNA, 20 bp, Artificial Sequence
  Description of Artificial Sequence: Synthetic oligonucleotide
  Target: ATXN1; (+) strand; PAM type: YTN; PAM sequence: TTC
tcaaactcctcaaatacaac

SEQ ID NO: 303219 - DNA, 20 bp, Artificial Sequence
  Description of Artificial Sequence: Synthetic oligonucleotide
  Target: ATXN1; (+) strand; PAM type: YTN; PAM sequence: CTC
aaactcctcaaatacaacac

SEQ ID NO: 303220 - DNA, 20 bp, Artificial Sequence
  Description of Artificial Sequence: Synthetic oligonucleotide
  Target: ATXN1; (+) strand; PAM type: YTN; PAM sequence: CTC
ctcaaatacaacaccaaatc

SEQ ID NO: 303221 - DNA, 20 bp, Artificial Sequence
  Description of Artificial Sequence: Synthetic oligonucleotide
  Target: ATXN1; (+) strand; PAM type: YTN; PAM sequence: CTC
aaatacaacaccaaatcctc

SEQ ID NO: 303222 - DNA, 20 bp, Artificial Sequence
  Description of Artificial Sequence: Synthetic oligonucleotide
  Target: ATXN1; (+) strand; PAM type: YTN; PAM sequence: CTC
ccggttgttccaccagtcct

SEQ ID NO: 303223 - DNA, 20 bp, Artificial Sequence
  Description of Artificial Sequence: Synthetic oligonucleotide
  Target: ATXN1; (+) strand; PAM type: YTN; PAM sequence: TTG
ttccaccagtcctcccactc

SEQ ID NO: 303224 - DNA, 20 bp, Artificial Sequence
  Description of Artificial Sequence: Synthetic oligonucleotide
  Target: ATXN1; (+) strand; PAM type: YTN; PAM sequence: TTC
caccagtcctcccactctac

SEQ ID NO: 303225 - DNA, 20 bp, Artificial Sequence
  Description of Artificial Sequence: Synthetic oligonucleotide
  Target: ATXN1; (+) strand; PAM type: YTN; PAM sequence: CTC
ccactctactgccactactc

SEQ ID NO: 303226 - DNA, 20 bp, Artificial Sequence
  Description of Artificial Sequence: Synthetic oligonucleotide
  Target: ATXN1; (+) strand; PAM type: YTN; PAM sequence: CTC
tactgccactactctaacct

SEQ ID NO: 303227 - DNA, 20 bp, Artificial Sequence
  Description of Artificial Sequence: Synthetic oligonucleotide
  Target: ATXN1; (+) strand; PAM type: YTN; PAM sequence: CTA
ctgccactactctaacctgg

SEQ ID NO: 303228 - DNA, 20 bp, Artificial Sequence
  Description of Artificial Sequence: Synthetic oligonucleotide
  Target: ATXN1; (+) strand; PAM type: YTN; PAM sequence: CTG
ccactactctaacctggacc

SEQ ID NO: 303229 - DNA, 20 bp, Artificial Sequence
  Description of Artificial Sequence: Synthetic oligonucleotide
  Target: ATXN1; (+) strand; PAM type: YTN; PAM sequence: CTA
ctctaacctggaccctccta

SEQ ID NO: 303230 - DNA, 20 bp, Artificial Sequence
  Description of Artificial Sequence: Synthetic oligonucleotide
  Target: ATXN1; (+) strand; PAM type: YTN; PAM sequence: CTC
taacctggaccctcctaaag

SEQ ID NO: 303231 - DNA, 20 bp, Artificial Sequence
  Description of Artificial Sequence: Synthetic oligonucleotide
  Target: ATXN1; (+) strand; PAM type: YTN; PAM sequence: CTA
acctggaccctcctaaagtc

SEQ ID NO: 303232 - DNA, 20 bp, Artificial Sequence
  Description of Artificial Sequence: Synthetic oligonucleotide
  Target: ATXN1; (+) strand; PAM type: YTN; PAM sequence: CTG
gaccctcctaaagtctcctg

SEQ ID NO: 303233 - DNA, 20 bp, Artificial Sequence
  Description of Artificial Sequence: Synthetic oligonucleotide
  Target: ATXN1; (+) strand; PAM type: YTN; PAM sequence: CTC
ctaaagtctcctggacttct

SEQ ID NO: 303234 - DNA, 20 bp, Artificial Sequence
  Description of Artificial Sequence: Synthetic oligonucleotide
  Target: ATXN1; (+) strand; PAM type: YTN; PAM sequence: CTA
aagtctcctggacttcttca

SEQ ID NO: 303235 - DNA, 20 bp, Artificial Sequence
  Description of Artificial Sequence: Synthetic oligonucleotide
  Target: ATXN1; (+) strand; PAM type: YTN; PAM sequence: CTC
ctggacttcttcaagagtac

SEQ ID NO: 303236 - DNA, 20 bp, Artificial Sequence
  Description of Artificial Sequence: Synthetic oligonucleotide
  Target: ATXN1; (+) strand; PAM type: YTN; PAM sequence: CTG
gacttcttcaagagtaccta

SEQ ID NO: 303237 - DNA, 20 bp, Artificial Sequence
  Description of Artificial Sequence: Synthetic oligonucleotide
  Target: ATXN1; (+) strand; PAM type: YTN; PAM sequence: CTT
cttcaagagtacctagatgg

SEQ ID NO: 303238 - DNA, 20 bp, Artificial Sequence
  Description of Artificial Sequence: Synthetic oligonucleotide
  Target: ATXN1; (+) strand; PAM type: YTN; PAM sequence: TTC
ttcaagagtacctagatggt

SEQ ID NO: 303239 - DNA, 20 bp, Artificial Sequence
  Description of Artificial Sequence: Synthetic oligonucleotide
  Target: ATXN1; (+) strand; PAM type: YTN; PAM sequence: CTT
caagagtacctagatggtct

SEQ ID NO: 303240 - DNA, 20 bp, Artificial Sequence
  Description of Artificial Sequence: Synthetic oligonucleotide
  Target: ATXN1; (+) strand; PAM type: YTN; PAM sequence: TTC
aagagtacctagatggtctc

SEQ ID NO: 303241 - DNA, 20 bp, Artificial Sequence
  Description of Artificial Sequence: Synthetic oligonucleotide
  Target: ATXN1; (+) strand; PAM type: YTN; PAM sequence: CTA
gatggtctctctgtctcaat

SEQ ID NO: 303242 - DNA, 20 bp, Artificial Sequence
  Description of Artificial Sequence: Synthetic oligonucleotide
  Target: ATXN1; (+) strand; PAM type: YTN; PAM sequence: CTC
tctgtctcaataacacccca

SEQ ID NO: 303243 - DNA, 20 bp, Artificial Sequence
  Description of Artificial Sequence: Synthetic oligonucleotide
  Target: ATXN1; (+) strand; PAM type: YTN; PAM sequence: CTC
tgtctcaataacaccccaat

SEQ ID NO: 303244 - DNA, 20 bp, Artificial Sequence
  Description of Artificial Sequence: Synthetic oligonucleotide
  Target: ATXN1; (+) strand; PAM type: YTN; PAM sequence: CTG
tctcaataacaccccaatga

SEQ ID NO: 303245 - DNA, 20 bp, Artificial Sequence
  Description of Artificial Sequence: Synthetic oligonucleotide
  Target: ATXN1; (+) strand; PAM type: YTN; PAM sequence: CTC
aataacaccccaatgaattc

SEQ ID NO: 303246 - DNA, 20 bp, Artificial Sequence
  Description of Artificial Sequence: Synthetic oligonucleotide
  Target: ATXN1; (+) strand; PAM type: YTN; PAM sequence: TTC
tatcttctactctgcccaga

SEQ ID NO: 303247 - DNA, 20 bp, Artificial Sequence
  Description of Artificial Sequence: Synthetic oligonucleotide
  Target: ATXN1; (+) strand; PAM type: YTN; PAM sequence: CTA
tcttctactctgcccagaga

SEQ ID NO: 303248 - DNA, 20 bp, Artificial Sequence
  Description of Artificial Sequence: Synthetic oligonucleotide
  Target: ATXN1; (+) strand; PAM type: YTN; PAM sequence: CTT
ctactctgcccagagaatga

SEQ ID NO: 303249 - DNA, 20 bp, Artificial Sequence
  Description of Artificial Sequence: Synthetic oligonucleotide
  Target: ATXN1; (+) strand; PAM type: YTN; PAM sequence: TTC
tactctgcccagagaatgaa

SEQ ID NO: 303250 - DNA, 20 bp, Artificial Sequence
  Description of Artificial Sequence: Synthetic oligonucleotide
  Target: ATXN1; (+) strand; PAM type: YTN; PAM sequence: CTA
ctctgcccagagaatgaact

SEQ ID NO: 303251 - DNA, 20 bp, Artificial Sequence
  Description of Artificial Sequence: Synthetic oligonucleotide
  Target: ATXN1; (+) strand; PAM type: YTN; PAM sequence: CTC
tgcccagagaatgaactttc

SEQ ID NO: 303252 - DNA, 20 bp, Artificial Sequence
  Description of Artificial Sequence: Synthetic oligonucleotide
  Target: ATXN1; (+) strand; PAM type: YTN; PAM sequence: CTG
cccagagaatgaactttcta

SEQ ID NO: 303253 - DNA, 20 bp, Artificial Sequence
  Description of Artificial Sequence: Synthetic oligonucleotide
  Target: ATXN1; (+) strand; PAM type: YTN; PAM sequence: CTT
tctaaaagtagaagtcattt

SEQ ID NO: 303254 - DNA, 20 bp, Artificial Sequence
  Description of Artificial Sequence: Synthetic oligonucleotide
  Target: ATXN1; (+) strand; PAM type: YTN; PAM sequence: TTT
ctaaaagtagaagtcatttc

SEQ ID NO: 303255 - DNA, 20 bp, Artificial Sequence
  Description of Artificial Sequence: Synthetic oligonucleotide
  Target: ATXN1; (+) strand; PAM type: YTN; PAM sequence: TTC
taaaagtagaagtcatttcc

SEQ ID NO: 303256 - DNA, 20 bp, Artificial Sequence
  Description of Artificial Sequence: Synthetic oligonucleotide
  Target: ATXN1; (+) strand; PAM type: YTN; PAM sequence: CTA
aaagtagaagtcatttccgg

SEQ ID NO: 303257 - DNA, 20 bp, Artificial Sequence
  Description of Artificial Sequence: Synthetic oligonucleotide
  Target: ATXN1; (+) strand; PAM type: YTN; PAM sequence: TTT
ccggttccaagcaaggtggg

SEQ ID NO: 303258 - DNA, 20 bp, Artificial Sequence
  Description of Artificial Sequence: Synthetic oligonucleotide
  Target: ATXN1; (+) strand; PAM type: YTN; PAM sequence: TTC
cggttccaagcaaggtgggg

SEQ ID NO: 303259 - DNA, 20 bp, Artificial Sequence
  Description of Artificial Sequence: Synthetic oligonucleotide
  Target: ATXN1; (+) strand; PAM type: YTN; PAM sequence: TTC
caagcaaggtggggaagttg

SEQ ID NO: 303260 - DNA, 20 bp, Artificial Sequence
  Description of Artificial Sequence: Synthetic oligonucleotide
  Target: ATXN1; (+) strand; PAM type: YTN; PAM sequence: TTG
cacaggctagaggttgatgc

SEQ ID NO: 303261 - DNA, 20 bp, Artificial Sequence
  Description of Artificial Sequence: Synthetic oligonucleotide
  Target: ATXN1; (+) strand; PAM type: YTN; PAM sequence: CTA
gaggttgatgcagctgagag

SEQ ID NO: 303262 - DNA, 20 bp, Artificial Sequence
  Description of Artificial Sequence: Synthetic oligonucleotide
  Target: ATXN1; (+) strand; PAM type: YTN; PAM sequence: TTG
atgcagctgagagttatttt

SEQ ID NO: 303263 - DNA, 20 bp, Artificial Sequence
  Description of Artificial Sequence: Synthetic oligonucleotide
  Target: ATXN1; (+) strand; PAM type: YTN; PAM sequence: CTG
agagttattttccatgtgat

SEQ ID NO: 303264 - DNA, 20 bp, Artificial Sequence
  Description of Artificial Sequence: Synthetic oligonucleotide
  Target: ATXN1; (+) strand; PAM type: YTN; PAM sequence: TTA
ttttccatgtgatggggaat

SEQ ID NO: 303265 - DNA, 20 bp, Artificial Sequence
  Description of Artificial Sequence: Synthetic oligonucleotide
  Target: ATXN1; (+) strand; PAM type: YTN; PAM sequence: TTT
tccatgtgatggggaattct

SEQ ID NO: 303266 - DNA, 20 bp, Artificial Sequence
  Description of Artificial Sequence: Synthetic oligonucleotide
  Target: ATXN1; (+) strand; PAM type: YTN; PAM sequence: TTT
ccatgtgatggggaattctt

SEQ ID NO: 303267 - DNA, 20 bp, Artificial Sequence
  Description of Artificial Sequence: Synthetic oligonucleotide
  Target: ATXN1; (+) strand; PAM type: YTN; PAM sequence: TTC
catgtgatggggaattcttg

SEQ ID NO: 303268 - DNA, 20 bp, Artificial Sequence
  Description of Artificial Sequence: Synthetic oligonucleotide
  Target: ATXN1; (+) strand; PAM type: YTN; PAM sequence: TTC
ttgcaggaaagaaggtggtt

SEQ ID NO: 303269 - DNA, 20 bp, Artificial Sequence
  Description of Artificial Sequence: Synthetic oligonucleotide
  Target: ATXN1; (+) strand; PAM type: YTN; PAM sequence: CTT
gcaggaaagaaggtggttaa

SEQ ID NO: 303270 - DNA, 20 bp, Artificial Sequence
  Description of Artificial Sequence: Synthetic oligonucleotide
  Target: ATXN1; (+) strand; PAM type: YTN; PAM sequence: TTG
caggaaagaaggtggttaag

SEQ ID NO: 303271 - DNA, 20 bp, Artificial Sequence
  Description of Artificial Sequence: Synthetic oligonucleotide
  Target: ATXN1; (+) strand; PAM type: YTN; PAM sequence: TTA
agtctcagtagagggaacac

SEQ ID NO: 303272 - DNA, 20 bp, Artificial Sequence
  Description of Artificial Sequence: Synthetic oligonucleotide
  Target: ATXN1; (+) strand; PAM type: YTN; PAM sequence: CTC
agtagagggaacactgggga

SEQ ID NO: 303273 - DNA, 20 bp, Artificial Sequence
  Description of Artificial Sequence: Synthetic oligonucleotide
  Target: ATXN1; (+) strand; PAM type: YTN; PAM sequence: CTG
gggaaaatagcagactgaga

SEQ ID NO: 303274 - DNA, 20 bp, Artificial Sequence
  Description of Artificial Sequence: Synthetic oligonucleotide
  Target: ATXN1; (+) strand; PAM type: YTN; PAM sequence: CTG
agagagaagaggtccaatgg

SEQ ID NO: 303275 - DNA, 20 bp, Artificial Sequence
  Description of Artificial Sequence: Synthetic oligonucleotide
  Target: ATXN1; (+) strand; PAM type: YTN; PAM sequence: TTA
tgagtgggggagtcatttgg

SEQ ID NO: 303276 - DNA, 20 bp, Artificial Sequence
  Description of Artificial Sequence: Synthetic oligonucleotide
  Target: ATXN1; (+) strand; PAM type: YTN; PAM sequence: TTT
ggggaacttaaaaattactg

SEQ ID NO: 303277 - DNA, 20 bp, Artificial Sequence
  Description of Artificial Sequence: Synthetic oligonucleotide
  Target: ATXN1; (+) strand; PAM type: YTN; PAM sequence: TTG
gggaacttaaaaattactga

SEQ ID NO: 303278 - DNA, 20 bp, Artificial Sequence
  Description of Artificial Sequence: Synthetic oligonucleotide
  Target: ATXN1; (+) strand; PAM type: YTN; PAM sequence: CTT
aaaaattactgataattttt

SEQ ID NO: 303279 - DNA, 20 bp, Artificial Sequence
  Description of Artificial Sequence: Synthetic oligonucleotide
  Target: ATXN1; (+) strand; PAM type: YTN; PAM sequence: TTA
aaaattactgataattttta

SEQ ID NO: 303280 - DNA, 20 bp, Artificial Sequence
  Description of Artificial Sequence: Synthetic oligonucleotide
  Target: ATXN1; (+) strand; PAM type: YTN; PAM sequence: TTA
ctgataatttttagacataa

SEQ ID NO: 303281 - DNA, 20 bp, Artificial Sequence
  Description of Artificial Sequence: Synthetic oligonucleotide
  Target: ATXN1; (+) strand; PAM type: YTN; PAM sequence: CTG
ataatttttagacataaagg

SEQ ID NO: 303282 - DNA, 20 bp, Artificial Sequence
  Description of Artificial Sequence: Synthetic oligonucleotide
  Target: ATXN1; (+) strand; PAM type: YTN; PAM sequence: TTT
ttagacataaaggaaactat

SEQ ID NO: 303283 - DNA, 20 bp, Artificial Sequence
  Description of Artificial Sequence: Synthetic oligonucleotide
  Target: ATXN1; (+) strand; PAM type: YTN; PAM sequence: TTT
tagacataaaggaaactatg

SEQ ID NO: 303284 - DNA, 20 bp, Artificial Sequence
  Description of Artificial Sequence: Synthetic oligonucleotide
  Target: ATXN1; (+) strand; PAM type: YTN; PAM sequence: TTT
agacataaaggaaactatgt

SEQ ID NO: 303285 - DNA, 20 bp, Artificial Sequence
  Description of Artificial Sequence: Synthetic oligonucleotide
  Target: ATXN1; (+) strand; PAM type: YTN; PAM sequence: TTA
gacataaaggaaactatgtt

SEQ ID NO: 303286 - DNA, 20 bp, Artificial Sequence
  Description of Artificial Sequence: Synthetic oligonucleotide
  Target: ATXN1; (+) strand; PAM type: YTN; PAM sequence: CTA
tgtttatacctaagtttatg

SEQ ID NO: 303287 - DNA, 20 bp, Artificial Sequence
  Description of Artificial Sequence: Synthetic oligonucleotide
  Target: ATXN1; (+) strand; PAM type: YTN; PAM sequence: TTT
atacctaagtttatgtttaa

SEQ ID NO: 303288 - DNA, 20 bp, Artificial Sequence
  Description of Artificial Sequence: Synthetic oligonucleotide
  Target: ATXN1; (+) strand; PAM type: YTN; PAM sequence: TTA
tacctaagtttatgtttaaa

SEQ ID NO: 303289 - DNA, 20 bp, Artificial Sequence
  Description of Artificial Sequence: Synthetic oligonucleotide
  Target: ATXN1; (+) strand; PAM type: YTN; PAM sequence: CTA
agtttatgtttaaataaagg

SEQ ID NO: 303290 - DNA, 20 bp, Artificial Sequence
  Description of Artificial Sequence: Synthetic oligonucleotide
  Target: ATXN1; (+) strand; PAM type: YTN; PAM sequence: TTT
atgtttaaataaaggtataa

SEQ ID NO: 303291 - DNA, 20 bp, Artificial Sequence
  Description of Artificial Sequence: Synthetic oligonucleotide
  Target: ATXN1; (+) strand; PAM type: YTN; PAM sequence: TTA
tgtttaaataaaggtataaa

SEQ ID NO: 303292 - DNA, 20 bp, Artificial Sequence
  Description of Artificial Sequence: Synthetic oligonucleotide
  Target: ATXN1; (+) strand; PAM type: YTN; PAM sequence: TTT
aaataaaggtataaatgcta

SEQ ID NO: 303293 - DNA, 20 bp, Artificial Sequence
  Description of Artificial Sequence: Synthetic oligonucleotide
  Target: ATXN1; (+) strand; PAM type: YTN; PAM sequence: TTA
aataaaggtataaatgctac

SEQ ID NO: 303294 - DNA, 20 bp, Artificial Sequence
  Description of Artificial Sequence: Synthetic oligonucleotide
  Target: ATXN1; (+) strand; PAM type: YTN; PAM sequence: CTA
caagaataaaataaaatgtg

SEQ ID NO: 303295 - DNA, 20 bp, Artificial Sequence
  Description of Artificial Sequence: Synthetic oligonucleotide
  Target: ATXN1; (+) strand; PAM type: YTN; PAM sequence: TTC
gggaaaaaaaatccgatcta

SEQ ID NO: 303296 - DNA, 20 bp, Artificial Sequence
  Description of Artificial Sequence: Synthetic oligonucleotide
  Target: ATXN1; (+) strand; PAM type: YTN; PAM sequence: CTA
tccaaaggaagaaagcaaaa

SEQ ID NO: 303297 - DNA, 20 bp, Artificial Sequence
  Description of Artificial Sequence: Synthetic oligonucleotide
  Target: ATXN1; (+) strand; PAM type: YTN; PAM sequence: TTA
aatgaagctaaaaatcttaa

SEQ ID NO: 303298 - DNA, 20 bp, Artificial Sequence
  Description of Artificial Sequence: Synthetic oligonucleotide
  Target: ATXN1; (+) strand; PAM type: YTN; PAM sequence: CTA
aaaatcttaataaaaatgat

SEQ ID NO: 303299 - DNA, 20 bp, Artificial Sequence
  Description of Artificial Sequence: Synthetic oligonucleotide
  Target: ATXN1; (+) strand; PAM type: YTN; PAM sequence: CTT
aataaaaatgattacagtaa

SEQ ID NO: 303300 - DNA, 20 bp, Artificial Sequence
  Description of Artificial Sequence: Synthetic oligonucleotide
  Target: ATXN1; (+) strand; PAM type: YTN; PAM sequence: TTA
ataaaaatgattacagtaag

SEQ ID NO: 303301 - DNA, 20 bp, Artificial Sequence
  Description of Artificial Sequence: Synthetic oligonucleotide
  Target: ATXN1; (+) strand; PAM type: YTN; PAM sequence: TTA
cagtaaggataactgggtat

SEQ ID NO: 303302 - DNA, 20 bp, Artificial Sequence
  Description of Artificial Sequence: Synthetic oligonucleotide
  Target: ATXN1; (+) strand; PAM type: YTN; PAM sequence: CTG
ggtataaagtcactaatcaa

SEQ ID NO: 303303 - DNA, 20 bp, Artificial Sequence
  Description of Artificial Sequence: Synthetic oligonucleotide
  Target: ATXN1; (+) strand; PAM type: YTN; PAM sequence: CTA
atcaaataacagagacaagt

SEQ ID NO: 303304 - DNA, 20 bp, Artificial Sequence
  Description of Artificial Sequence: Synthetic oligonucleotide
  Target: ATXN1; (+) strand; PAM type: YTN; PAM sequence: CTA
tgcacaatatgtggtggggg

SEQ ID NO: 303305 - DNA, 20 bp, Artificial Sequence
  Description of Artificial Sequence: Synthetic oligonucleotide
  Target: ATXN1; (+) strand; PAM type: YTN; PAM sequence: TTA
aaactaaaagatttttaaaa

SEQ ID NO: 303306 - DNA, 20 bp, Artificial Sequence
  Description of Artificial Sequence: Synthetic oligonucleotide
  Target: ATXN1; (+) strand; PAM type: YTN; PAM sequence: CTA
aaagatttttaaaaaagaaa

SEQ ID NO: 303307 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaagaaaatataagc

SEQ ID NO: 303308 - DNA, 20 bp, Artificial Sequence
  Description of Artificial Sequence: Synthetic oligonucleotide
  Target: ATXN1; (+) strand; PAM type: YTN; PAM sequence: TTT
taaaaaagaaaatataagca

SEQ ID NO: 303309 - DNA, 20 bp, Artificial Sequence
  Description of Artificial Sequence: Synthetic oligonucleotide
  Target: ATXN1; (+) strand; PAM type: YTN; PAM sequence: TTT
aaaaaagaaaatataagcaa

SEQ ID NO: 303310 - DNA, 20 bp, Artificial Sequence
  Description of Artificial Sequence: Synthetic oligonucleotide
  Target: ATXN1; (+) strand; PAM type: YTN; PAM sequence: TTA
aaaaagaaaatataagcaaa

SEQ ID NO: 303311 - DNA, 20 bp, Artificial Sequence
  Description of Artificial Sequence: Synthetic oligonucleotide
  Target: ATXN1; (+) strand; PAM type: YTN; PAM sequence: CTA
aaaacaaaaaccaggatagc

SEQ ID NO: 303312 - DNA, 20 bp, Artificial Sequence
  Description of Artificial Sequence: Synthetic oligonucleotide
  Target: ATXN1; (+) strand; PAM type: YTN; PAM sequence: CTC
tgaatatcagacaaaatgga

SEQ ID NO: 303313 - DNA, 20 bp, Artificial Sequence
  Description of Artificial Sequence: Synthetic oligonucleotide
  Target: ATXN1; (+) strand; PAM type: YTN; PAM sequence: CTG
aatatcagacaaaatggaat

SEQ ID NO: 303314 - DNA, 20 bp, Artificial Sequence
  Description of Artificial Sequence: Synthetic oligonucleotide
  Target: ATXN1; (+) strand; PAM type: YTN; PAM sequence: TTA
aaagcattataaatgatggt

SEQ ID NO: 303315 - DNA, 20 bp, Artificial Sequence
  Description of Artificial Sequence: Synthetic oligonucleotide
  Target: ATXN1; (+) strand; PAM type: YTN; PAM sequence: TTA
taaatgatggtgagggacat

SEQ ID NO: 303316 - DNA, 20 bp, Artificial Sequence
  Description of Artificial Sequence: Synthetic oligonucleotide
  Target: ATXN1; (+) strand; PAM type: YTN; PAM sequence: CTA
ggctggcaaaaggaacaacc

SEQ ID NO: 303317 - DNA, 20 bp, Artificial Sequence
  Description of Artificial Sequence: Synthetic oligonucleotide
  Target: ATXN1; (+) strand; PAM type: YTN; PAM sequence: CTG
gcaaaaggaacaaccaataa

SEQ ID NO: 303318 - DNA, 20 bp, Artificial Sequence
  Description of Artificial Sequence: Synthetic oligonucleotide
  Target: ATXN1; (+) strand; PAM type: YTN; PAM sequence: TTT
tataatcgtcaacatacatg

SEQ ID NO: 303319 - DNA, 20 bp, Artificial Sequence
  Description of Artificial Sequence: Synthetic oligonucleotide
  Target: ATXN1; (+) strand; PAM type: YTN; PAM sequence: TTT
ataatcgtcaacatacatgc

SEQ ID NO: 303320 - DNA, 20 bp, Artificial Sequence
  Description of Artificial Sequence: Synthetic oligonucleotide
  Target: ATXN1; (+) strand; PAM type: YTN; PAM sequence: TTA
taatcgtcaacatacatgca

SEQ ID NO: 303321 - DNA, 20 bp, Artificial Sequence
  Description of Artificial Sequence: Synthetic oligonucleotide
  Target: ATXN1; (+) strand; PAM type: YTN; PAM sequence: CTA
acaaaatggcacagagatat

SEQ ID NO: 303322 - DNA, 20 bp, Artificial Sequence
  Description of Artificial Sequence: Synthetic oligonucleotide
  Target: ATXN1; (+) strand; PAM type: YTN; PAM sequence: TTT
aaagcaacaactatgaagag

SEQ ID NO: 303323 - DNA, 20 bp, Artificial Sequence
  Description of Artificial Sequence: Synthetic oligonucleotide
  Target: ATXN1; (+) strand; PAM type: YTN; PAM sequence: TTA
aagcaacaactatgaagaga

SEQ ID NO: 303324 - DNA, 20 bp, Artificial Sequence
  Description of Artificial Sequence: Synthetic oligonucleotide
  Target: ATXN1; (+) strand; PAM type: YTN; PAM sequence: CTA
tgaagagaaataaataaata

SEQ ID NO: 303325 - DNA, 20 bp, Artificial Sequence
  Description of Artificial Sequence: Synthetic oligonucleotide
  Target: ATXN1; (+) strand; PAM type: YTN; PAM sequence: TTA
gcaattaaggaaaaaaggga

SEQ ID NO: 303326 - DNA, 20 bp, Artificial Sequence
  Description of Artificial Sequence: Synthetic oligonucleotide
  Target: ATXN1; (+) strand; PAM type: YTN; PAM sequence: TTA
aggaaaaaagggaagcttaa

SEQ ID NO: 303327 - DNA, 20 bp, Artificial Sequence
  Description of Artificial Sequence: Synthetic oligonucleotide
  Target: ATXN1; (+) strand; PAM type: YTN; PAM sequence: CTT
aaaaattccccacgtctgtg

SEQ ID NO: 303328 - DNA, 20 bp, Artificial Sequence
  Description of Artificial Sequence: Synthetic oligonucleotide
  Target: ATXN1; (+) strand; PAM type: YTN; PAM sequence: TTA
aaaattccccacgtctgtga

SEQ ID NO: 303329 - DNA, 20 bp, Artificial Sequence
  Description of Artificial Sequence: Synthetic oligonucleotide
  Target: ATXN1; (+) strand; PAM type: YTN; PAM sequence: TTC
cccacgtctgtgaattaaaa

SEQ ID NO: 303330 - DNA, 20 bp, Artificial Sequence
  Description of Artificial Sequence: Synthetic oligonucleotide
  Target: ATXN1; (+) strand; PAM type: YTN; PAM sequence: CTG
tgaattaaaatgtttactac

SEQ ID NO: 303331 - DNA, 20 bp, Artificial Sequence
  Description of Artificial Sequence: Synthetic oligonucleotide
  Target: ATXN1; (+) strand; PAM type: YTN; PAM sequence: TTA
aaatgtttactactagacaa

SEQ ID NO: 303332 - DNA, 20 bp, Artificial Sequence
  Description of Artificial Sequence: Synthetic oligonucleotide
  Target: ATXN1; (+) strand; PAM type: YTN; PAM sequence: TTT
actactagacaattcccaga

SEQ ID NO: 303333 - DNA, 20 bp, Artificial Sequence
  Description of Artificial Sequence: Synthetic oligonucleotide
  Target: ATXN1; (+) strand; PAM type: YTN; PAM sequence: TTA
ctactagacaattcccagag

SEQ ID NO: 303334 - DNA, 20 bp, Artificial Sequence
  Description of Artificial Sequence: Synthetic oligonucleotide
  Target: ATXN1; (+) strand; PAM type: YTN; PAM sequence: CTA
ctagacaattcccagaggaa

SEQ ID NO: 303335 - DNA, 20 bp, Artificial Sequence
  Description of Artificial Sequence: Synthetic oligonucleotide
  Target: ATXN1; (+) strand; PAM type: YTN; PAM sequence: CTA
gacaattcccagaggaaata

SEQ ID NO: 303336 - DNA, 20 bp, Artificial Sequence
  Description of Artificial Sequence: Synthetic oligonucleotide
  Target: ATXN1; (+) strand; PAM type: YTN; PAM sequence: TTC
ccagaggaaataaaatggaa

SEQ ID NO: 303337 - DNA, 20 bp, Artificial Sequence
  Description of Artificial Sequence: Synthetic oligonucleotide
  Target: ATXN1; (+) strand; PAM type: YTN; PAM sequence: CTG
agttaagtgacaataaaagt

SEQ ID NO: 303338 - DNA, 20 bp, Artificial Sequence
  Description of Artificial Sequence: Synthetic oligonucleotide
  Target: ATXN1; (+) strand; PAM type: YTN; PAM sequence: TTA
agtgacaataaaagtatata

SEQ ID NO: 303339 - DNA, 20 bp, Artificial Sequence
  Description of Artificial Sequence: Synthetic oligonucleotide
  Target: ATXN1; (+) strand; PAM type: YTN; PAM sequence: TTT
gtacaatgcaattaaaacat

SEQ ID NO: 303340 - DNA, 20 bp, Artificial Sequence
  Description of Artificial Sequence: Synthetic oligonucleotide
  Target: ATXN1; (+) strand; PAM type: YTN; PAM sequence: TTG
tacaatgcaattaaaacata

SEQ ID NO: 303341 - DNA, 20 bp, Artificial Sequence
  Description of Artificial Sequence: Synthetic oligonucleotide
  Target: ATXN1; (+) strand; PAM type: YTN; PAM sequence: TTA
aaacataagggctcattgca

SEQ ID NO: 303342 - DNA, 20 bp, Artificial Sequence
  Description of Artificial Sequence: Synthetic oligonucleotide
  Target: ATXN1; (+) strand; PAM type: YTN; PAM sequence: CTC
attgcaagacctcggctgaa

SEQ ID NO: 303343 - DNA, 20 bp, Artificial Sequence
  Description of Artificial Sequence: Synthetic oligonucleotide
  Target: ATXN1; (+) strand; PAM type: YTN; PAM sequence: TTG
caagacctcggctgaagtct

SEQ ID NO: 303344 - DNA, 20 bp, Artificial Sequence
  Description of Artificial Sequence: Synthetic oligonucleotide
  Target: ATXN1; (+) strand; PAM type: YTN; PAM sequence: CTC
ggctgaagtctgaacagcct

SEQ ID NO: 303345 - DNA, 20 bp, Artificial Sequence
  Description of Artificial Sequence: Synthetic oligonucleotide
  Target: ATXN1; (+) strand; PAM type: YTN; PAM sequence: CTG
aagtctgaacagcctgcagc

SEQ ID NO: 303346 - DNA, 20 bp, Artificial Sequence
  Description of Artificial Sequence: Synthetic oligonucleotide
  Target: ATXN1; (+) strand; PAM type: YTN; PAM sequence: CTG
aacagcctgcagctcttgta

SEQ ID NO: 303347 - DNA, 20 bp, Artificial Sequence
  Description of Artificial Sequence: Synthetic oligonucleotide
  Target: ATXN1; (+) strand; PAM type: YTN; PAM sequence: CTG
cagctcttgtagccatattc

SEQ ID NO: 303348 - DNA, 20 bp, Artificial Sequence
  Description of Artificial Sequence: Synthetic oligonucleotide
  Target: ATXN1; (+) strand; PAM type: YTN; PAM sequence: CTC
ttgtagccatattcagatca

SEQ ID NO: 303349 - DNA, 20 bp, Artificial Sequence
  Description of Artificial Sequence: Synthetic oligonucleotide
  Target: ATXN1; (+) strand; PAM type: YTN; PAM sequence: CTT
gtagccatattcagatcagt

SEQ ID NO: 303350 - DNA, 20 bp, Artificial Sequence
  Description of Artificial Sequence: Synthetic oligonucleotide
  Target: ATXN1; (+) strand; PAM type: YTN; PAM sequence: TTG
tagccatattcagatcagta

SEQ ID NO: 303351 - DNA, 20 bp, Artificial Sequence
  Description of Artificial Sequence: Synthetic oligonucleotide
  Target: ATXN1; (+) strand; PAM type: YTN; PAM sequence: TTC
agatcagtagatttctagac

SEQ ID NO: 303352 - DNA, 20 bp, Artificial Sequence
  Description of Artificial Sequence: Synthetic oligonucleotide
  Target: ATXN1; (+) strand; PAM type: YTN; PAM sequence: TTT
ctagacaaggagaattgcca

SEQ ID NO: 303353 - DNA, 20 bp, Artificial Sequence
  Description of Artificial Sequence: Synthetic oligonucleotide
  Target: ATXN1; (+) strand; PAM type: YTN; PAM sequence: TTC
tagacaaggagaattgccag

SEQ ID NO: 303354 - DNA, 20 bp, Artificial Sequence
  Description of Artificial Sequence: Synthetic oligonucleotide
  Target: ATXN1; (+) strand; PAM type: YTN; PAM sequence: CTA
gacaaggagaattgccagag

SEQ ID NO: 303355 - DNA, 20 bp, Artificial Sequence
  Description of Artificial Sequence: Synthetic oligonucleotide
  Target: ATXN1; (+) strand; PAM type: YTN; PAM sequence: TTG
ccagagttaaagggtcattt

SEQ ID NO: 303356 - DNA, 20 bp, Artificial Sequence
  Description of Artificial Sequence: Synthetic oligonucleotide
  Target: ATXN1; (+) strand; PAM type: YTN; PAM sequence: TTA
aagggtcatttcataataat

SEQ ID NO: 303357 - DNA, 20 bp, Artificial Sequence
  Description of Artificial Sequence: Synthetic oligonucleotide
  Target: ATXN1; (+) strand; PAM type: YTN; PAM sequence: TTT
cataataattaaagggtgta

SEQ ID NO: 303358 - DNA, 20 bp, Artificial Sequence
  Description of Artificial Sequence: Synthetic oligonucleotide
  Target: ATXN1; (+) strand; PAM type: YTN; PAM sequence: TTC
ataataattaaagggtgtac

SEQ ID NO: 303359 - DNA, 20 bp, Artificial Sequence
  Description of Artificial Sequence: Synthetic oligonucleotide
  Target: ATXN1; (+) strand; PAM type: YTN; PAM sequence: TTA
aagggtgtacttattaggaa

SEQ ID NO: 303360 - DNA, 20 bp, Artificial Sequence
  Description of Artificial Sequence: Synthetic oligonucleotide
  Target: ATXN1; (+) strand; PAM type: YTN; PAM sequence: CTT
attaggaagatacatcaatc

SEQ ID NO: 303361 - DNA, 20 bp, Artificial Sequence
  Description of Artificial Sequence: Synthetic oligonucleotide
  Target: ATXN1; (+) strand; PAM type: YTN; PAM sequence: TTA
ttaggaagatacatcaatct

SEQ ID NO: 303362 - DNA, 20 bp, Artificial Sequence
  Description of Artificial Sequence: Synthetic oligonucleotide
  Target: ATXN1; (+) strand; PAM type: YTN; PAM sequence: TTA
ggaagatacatcaatcttaa

SEQ ID NO: 303363 - DNA, 20 bp, Artificial Sequence
  Description of Artificial Sequence: Synthetic oligonucleotide
  Target: ATXN1; (+) strand; PAM type: YTN; PAM sequence: CTT
aaaagtgtgtgtacctagga

SEQ ID NO: 303364 - DNA, 20 bp, Artificial Sequence
  Description of Artificial Sequence: Synthetic oligonucleotide
  Target: ATXN1; (+) strand; PAM type: YTN; PAM sequence: TTA
aaagtgtgtgtacctaggaa

SEQ ID NO: 303365 - DNA, 20 bp, Artificial Sequence
  Description of Artificial Sequence: Synthetic oligonucleotide
  Target: ATXN1; (+) strand; PAM type: YTN; PAM sequence: CTA
ggaacagaaaaaaaaagaag

SEQ ID NO: 303366 - DNA, 20 bp, Artificial Sequence
  Description of Artificial Sequence: Synthetic oligonucleotide
  Target: ATXN1; (+) strand; PAM type: YTN; PAM sequence: TTC
aaatcagtgatatagagaaa

SEQ ID NO: 303367 - DNA, 20 bp, Artificial Sequence
  Description of Artificial Sequence: Synthetic oligonucleotide
  Target: ATXN1; (+) strand; PAM type: YTN; PAM sequence: CTC
atgcctataatcctagcact

SEQ ID NO: 303368 - DNA, 20 bp, Artificial Sequence
  Description of Artificial Sequence: Synthetic oligonucleotide
  Target: ATXN1; (+) strand; PAM type: YTN; PAM sequence: CTA
taatcctagcactttgggag

SEQ ID NO: 303369 - DNA, 20 bp, Artificial Sequence
  Description of Artificial Sequence: Synthetic oligonucleotide
  Target: ATXN1; (+) strand; PAM type: YTN; PAM sequence: CTA
gcactttgggaggccaaggc

SEQ ID NO: 303370 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcaggtgg

SEQ ID NO: 303371 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcaggtgga

SEQ ID NO: 303372 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcaggtggaa

SEQ ID NO: 303373 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcaagacca

SEQ ID NO: 303374 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaacgt

SEQ ID NO: 303375 - DNA, 20 bp, Artificial Sequence
  Description of Artificial Sequence: Synthetic oligonucleotide
  Target: ATXN1; (+) strand; PAM type: YTN; PAM sequence: CTG
gccaacgtggcgaaaccctg

SEQ ID NO: 303376 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 303377 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 303378 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 303379 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 303380 - DNA, 20 bp, Artificial Sequence
  Description of Artificial Sequence: Synthetic oligonucleotide
  Target: ATXN1; (+) strand; PAM type: YTN; PAM sequence: TTA
gctgggcacggtggtgcatg

SEQ ID NO: 303381 - DNA, 20 bp, Artificial Sequence
  Description of Artificial Sequence: Synthetic oligonucleotide
  Target: ATXN1; (+) strand; PAM type: YTN; PAM sequence: CTG
ggcacggtggtgcatgcctg

SEQ ID NO: 303382 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 303383 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 303384 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 303385 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 303386 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 303387 - DNA, 20 bp, Artificial Sequence
  Description of Artificial Sequence: Synthetic oligonucleotide
  Target: ATXN1; (+) strand; PAM type: YTN; PAM sequence: CTT
gaacccagggaacagagttt

SEQ ID NO: 303388 - DNA, 20 bp, Artificial Sequence
  Description of Artificial Sequence: Synthetic oligonucleotide
  Target: ATXN1; (+) strand; PAM type: YTN; PAM sequence: TTG
aacccagggaacagagtttg

SEQ ID NO: 303389 - DNA, 20 bp, Artificial Sequence
  Description of Artificial Sequence: Synthetic oligonucleotide
  Target: ATXN1; (+) strand; PAM type: YTN; PAM sequence: TTT
gcagtgagccaagattgtgc

SEQ ID NO: 303390 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagattgtgcc

SEQ ID NO: 303391 - DNA, 20 bp, Artificial Sequence
  Description of Artificial Sequence: Synthetic oligonucleotide
  Target: ATXN1; (+) strand; PAM type: YTN; PAM sequence: TTG
tgccactgaactccagcctg

SEQ ID NO: 303392 - DNA, 20 bp, Artificial Sequence
  Description of Artificial Sequence: Synthetic oligonucleotide
  Target: ATXN1; (+) strand; PAM type: YTN; PAM sequence: CTG
aactccagcctgggtgaaag

SEQ ID NO: 303393 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgaaagagcga

SEQ ID NO: 303394 - DNA, 20 bp, Artificial Sequence
  Description of Artificial Sequence: Synthetic oligonucleotide
  Target: ATXN1; (+) strand; PAM type: YTN; PAM sequence: CTG
ggtgaaagagcgaaactctg

SEQ ID NO: 303395 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaag

SEQ ID NO: 303396 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaagaa

SEQ ID NO: 303397 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaagaaaaga

SEQ ID NO: 303398 - DNA, 20 bp, Artificial Sequence
  Description of Artificial Sequence: Synthetic oligonucleotide
  Target: ATXN1; (+) strand; PAM type: YTN; PAM sequence: TTA
aatccaaagtagggaaaaag

SEQ ID NO: 303399 - DNA, 20 bp, Artificial Sequence
  Description of Artificial Sequence: Synthetic oligonucleotide
  Target: ATXN1; (+) strand; PAM type: YTN; PAM sequence: TTC
attctttgaagagcttaata

SEQ ID NO: 303400 - DNA, 20 bp, Artificial Sequence
  Description of Artificial Sequence: Synthetic oligonucleotide
  Target: ATXN1; (+) strand; PAM type: YTN; PAM sequence: TTC
tttgaagagcttaataaaat

SEQ ID NO: 303401 - DNA, 20 bp, Artificial Sequence
  Description of Artificial Sequence: Synthetic oligonucleotide
  Target: ATXN1; (+) strand; PAM type: YTN; PAM sequence: CTT
tgaagagcttaataaaatta

SEQ ID NO: 303402 - DNA, 20 bp, Artificial Sequence
  Description of Artificial Sequence: Synthetic oligonucleotide
  Target: ATXN1; (+) strand; PAM type: YTN; PAM sequence: TTT
gaagagcttaataaaattaa

SEQ ID NO: 303403 - DNA, 20 bp, Artificial Sequence
  Description of Artificial Sequence: Synthetic oligonucleotide
  Target: ATXN1; (+) strand; PAM type: YTN; PAM sequence: TTG
aagagcttaataaaattaat

SEQ ID NO: 303404 - DNA, 20 bp, Artificial Sequence
  Description of Artificial Sequence: Synthetic oligonucleotide
  Target: ATXN1; (+) strand; PAM type: YTN; PAM sequence: CTT
aataaaattaattaacatct

SEQ ID NO: 303405 - DNA, 20 bp, Artificial Sequence
  Description of Artificial Sequence: Synthetic oligonucleotide
  Target: ATXN1; (+) strand; PAM type: YTN; PAM sequence: TTA
ataaaattaattaacatcta

SEQ ID NO: 303406 - DNA, 20 bp, Artificial Sequence
  Description of Artificial Sequence: Synthetic oligonucleotide
  Target: ATXN1; (+) strand; PAM type: YTN; PAM sequence: TTA
attaacatctagcaaaacta

SEQ ID NO: 303407 - DNA, 20 bp, Artificial Sequence
  Description of Artificial Sequence: Synthetic oligonucleotide
  Target: ATXN1; (+) strand; PAM type: YTN; PAM sequence: TTA
acatctagcaaaactaatca

SEQ ID NO: 303408 - DNA, 20 bp, Artificial Sequence
  Description of Artificial Sequence: Synthetic oligonucleotide
  Target: ATXN1; (+) strand; PAM type: YTN; PAM sequence: CTA
gcaaaactaatcacaaaaat

SEQ ID NO: 303409 - DNA, 20 bp, Artificial Sequence
  Description of Artificial Sequence: Synthetic oligonucleotide
  Target: ATXN1; (+) strand; PAM type: YTN; PAM sequence: CTA
atcacaaaaataagtaaatg

SEQ ID NO: 303410 - DNA, 20 bp, Artificial Sequence
  Description of Artificial Sequence: Synthetic oligonucleotide
  Target: ATXN1; (+) strand; PAM type: YTN; PAM sequence: TTA
aaaatggaaaaggggatatc

SEQ ID NO: 303411 - DNA, 20 bp, Artificial Sequence
  Description of Artificial Sequence: Synthetic oligonucleotide
  Target: ATXN1; (+) strand; PAM type: YTN; PAM sequence: CTA
taaatcctacagacactaaa

SEQ ID NO: 303412 - DNA, 20 bp, Artificial Sequence
  Description of Artificial Sequence: Synthetic oligonucleotide
  Target: ATXN1; (+) strand; PAM type: YTN; PAM sequence: CTA
cagacactaaatagataaga

SEQ ID NO: 303413 - DNA, 20 bp, Artificial Sequence
  Description of Artificial Sequence: Synthetic oligonucleotide
  Target: ATXN1; (+) strand; PAM type: YTN; PAM sequence: CTA
aatagataagaagaaagtat

SEQ ID NO: 303414 - DNA, 20 bp, Artificial Sequence
  Description of Artificial Sequence: Synthetic oligonucleotide
  Target: ATXN1; (+) strand; PAM type: YTN; PAM sequence: TTA
ctaaaaactttatgtcaata

SEQ ID NO: 303415 - DNA, 20 bp, Artificial Sequence
  Description of Artificial Sequence: Synthetic oligonucleotide
  Target: ATXN1; (+) strand; PAM type: YTN; PAM sequence: CTA
aaaactttatgtcaataaat

SEQ ID NO: 303416 - DNA, 20 bp, Artificial Sequence
  Description of Artificial Sequence: Synthetic oligonucleotide
  Target: ATXN1; (+) strand; PAM type: YTN; PAM sequence: CTT
tatgtcaataaatctcacaa

SEQ ID NO: 303417 - DNA, 20 bp, Artificial Sequence
  Description of Artificial Sequence: Synthetic oligonucleotide
  Target: ATXN1; (+) strand; PAM type: YTN; PAM sequence: TTT
atgtcaataaatctcacaac

SEQ ID NO: 303418 - DNA, 20 bp, Artificial Sequence
  Description of Artificial Sequence: Synthetic oligonucleotide
  Target: ATXN1; (+) strand; PAM type: YTN; PAM sequence: TTA
tgtcaataaatctcacaact

SEQ ID NO: 303419 - DNA, 20 bp, Artificial Sequence
  Description of Artificial Sequence: Synthetic oligonucleotide
  Target: ATXN1; (+) strand; PAM type: YTN; PAM sequence: CTC
acaacttggatgaaataaaa

SEQ ID NO: 303420 - DNA, 20 bp, Artificial Sequence
  Description of Artificial Sequence: Synthetic oligonucleotide
  Target: ATXN1; (+) strand; PAM type: YTN; PAM sequence: CTT
ggatgaaataaaaaacttct

SEQ ID NO: 303421 - DNA, 20 bp, Artificial Sequence
  Description of Artificial Sequence: Synthetic oligonucleotide
  Target: ATXN1; (+) strand; PAM type: YTN; PAM sequence: TTG
gatgaaataaaaaacttctt

SEQ ID NO: 303422 - DNA, 20 bp, Artificial Sequence
  Description of Artificial Sequence: Synthetic oligonucleotide
  Target: ATXN1; (+) strand; PAM type: YTN; PAM sequence: CTT
cttgaaaaatagaaagcata

SEQ ID NO: 303423 - DNA, 20 bp, Artificial Sequence
  Description of Artificial Sequence: Synthetic oligonucleotide
  Target: ATXN1; (+) strand; PAM type: YTN; PAM sequence: TTC
ttgaaaaatagaaagcataa

SEQ ID NO: 303424 - DNA, 20 bp, Artificial Sequence
  Description of Artificial Sequence: Synthetic oligonucleotide
  Target: ATXN1; (+) strand; PAM type: YTN; PAM sequence: CTT
gaaaaatagaaagcataact

SEQ ID NO: 303425 - DNA, 20 bp, Artificial Sequence
  Description of Artificial Sequence: Synthetic oligonucleotide
  Target: ATXN1; (+) strand; PAM type: YTN; PAM sequence: TTG
aaaaatagaaagcataactt

SEQ ID NO: 303426 - DNA, 20 bp, Artificial Sequence
  Description of Artificial Sequence: Synthetic oligonucleotide
  Target: ATXN1; (+) strand; PAM type: YTN; PAM sequence: CTT
accaatagcaagaataaaca

SEQ ID NO: 303427 - DNA, 20 bp, Artificial Sequence
  Description of Artificial Sequence: Synthetic oligonucleotide
  Target: ATXN1; (+) strand; PAM type: YTN; PAM sequence: TTA
ccaatagcaagaataaacag

SEQ ID NO: 303428 - DNA, 20 bp, Artificial Sequence
  Description of Artificial Sequence: Synthetic oligonucleotide
  Target: ATXN1; (+) strand; PAM type: YTN; PAM sequence: CTG
aagagttggctatatgttaa

SEQ ID NO: 303429 - DNA, 20 bp, Artificial Sequence
  Description of Artificial Sequence: Synthetic oligonucleotide
  Target: ATXN1; (+) strand; PAM type: YTN; PAM sequence: TTG
gctatatgttaagaaattga

SEQ ID NO: 303430 - DNA, 20 bp, Artificial Sequence
  Description of Artificial Sequence: Synthetic oligonucleotide
  Target: ATXN1; (+) strand; PAM type: YTN; PAM sequence: CTA
tatgttaagaaattgaattc

SEQ ID NO: 303431 - DNA, 20 bp, Artificial Sequence
  Description of Artificial Sequence: Synthetic oligonucleotide
  Target: ATXN1; (+) strand; PAM type: YTN; PAM sequence: TTA
agaaattgaattcagtatca

SEQ ID NO: 303432 - DNA, 20 bp, Artificial Sequence
  Description of Artificial Sequence: Synthetic oligonucleotide
  Target: ATXN1; (+) strand; PAM type: YTN; PAM sequence: TTG
aattcagtatcaaaatcctt

SEQ ID NO: 303433 - DNA, 20 bp, Artificial Sequence
  Description of Artificial Sequence: Synthetic oligonucleotide
  Target: ATXN1; (+) strand; PAM type: YTN; PAM sequence: TTC
agtatcaaaatccttggcac

SEQ ID NO: 303434 - DNA, 20 bp, Artificial Sequence
  Description of Artificial Sequence: Synthetic oligonucleotide
  Target: ATXN1; (+) strand; PAM type: YTN; PAM sequence: CTT
ggcacaatgatgatacaact

SEQ ID NO: 303435 - DNA, 20 bp, Artificial Sequence
  Description of Artificial Sequence: Synthetic oligonucleotide
  Target: ATXN1; (+) strand; PAM type: YTN; PAM sequence: TTG
gcacaatgatgatacaactg

SEQ ID NO: 303436 - DNA, 20 bp, Artificial Sequence
  Description of Artificial Sequence: Synthetic oligonucleotide
  Target: ATXN1; (+) strand; PAM type: YTN; PAM sequence: CTG
ttctgtatcctgattgtggt

SEQ ID NO: 303437 - DNA, 20 bp, Artificial Sequence
  Description of Artificial Sequence: Synthetic oligonucleotide
  Target: ATXN1; (+) strand; PAM type: YTN; PAM sequence: TTC
tgtatcctgattgtggtggt

SEQ ID NO: 303438 - DNA, 20 bp, Artificial Sequence
  Description of Artificial Sequence: Synthetic oligonucleotide
  Target: ATXN1; (+) strand; PAM type: YTN; PAM sequence: CTG
tatcctgattgtggtggtag

SEQ ID NO: 303439 - DNA, 20 bp, Artificial Sequence
  Description of Artificial Sequence: Synthetic oligonucleotide
  Target: ATXN1; (+) strand; PAM type: YTN; PAM sequence: CTG
attgtggtggtagttatgca

SEQ ID NO: 303440 - DNA, 20 bp, Artificial Sequence
  Description of Artificial Sequence: Synthetic oligonucleotide
  Target: ATXN1; (+) strand; PAM type: YTN; PAM sequence: TTG
tggtggtagttatgcaactc

SEQ ID NO: 303441 - DNA, 20 bp, Artificial Sequence
  Description of Artificial Sequence: Synthetic oligonucleotide
  Target: ATXN1; (+) strand; PAM type: YTN; PAM sequence: TTA
tgcaactctacacatgttaa

SEQ ID NO: 303442 - DNA, 20 bp, Artificial Sequence
  Description of Artificial Sequence: Synthetic oligonucleotide
  Target: ATXN1; (+) strand; PAM type: YTN; PAM sequence: CTC
tacacatgttaaaatgcata

SEQ ID NO: 303443 - DNA, 20 bp, Artificial Sequence
  Description of Artificial Sequence: Synthetic oligonucleotide
  Target: ATXN1; (+) strand; PAM type: YTN; PAM sequence: CTA
cacatgttaaaatgcataga

SEQ ID NO: 303444 - DNA, 20 bp, Artificial Sequence
  Description of Artificial Sequence: Synthetic oligonucleotide
  Target: ATXN1; (+) strand; PAM type: YTN; PAM sequence: TTA
aaatgcatagaattgtacat

SEQ ID NO: 303445 - DNA, 20 bp, Artificial Sequence
  Description of Artificial Sequence: Synthetic oligonucleotide
  Target: ATXN1; (+) strand; PAM type: YTN; PAM sequence: TTG
tacatcaaaaaagggaatat

SEQ ID NO: 303446 - DNA, 20 bp, Artificial Sequence
  Description of Artificial Sequence: Synthetic oligonucleotide
  Target: ATXN1; (+) strand; PAM type: YTN; PAM sequence: TTT
tactttataatgtttttaaa

SEQ ID NO: 303447 - DNA, 20 bp, Artificial Sequence
  Description of Artificial Sequence: Synthetic oligonucleotide
  Target: ATXN1; (+) strand; PAM type: YTN; PAM sequence: TTT
actttataatgtttttaaat

SEQ ID NO: 303448 - DNA, 20 bp, Artificial Sequence
  Description of Artificial Sequence: Synthetic oligonucleotide
  Target: ATXN1; (+) strand; PAM type: YTN; PAM sequence: TTA
ctttataatgtttttaaatt

SEQ ID NO: 303449 - DNA, 20 bp, Artificial Sequence
  Description of Artificial Sequence: Synthetic oligonucleotide
  Target: ATXN1; (+) strand; PAM type: YTN; PAM sequence: CTT
tataatgtttttaaattaaa

SEQ ID NO: 303450 - DNA, 20 bp, Artificial Sequence
  Description of Artificial Sequence: Synthetic oligonucleotide
  Target: ATXN1; (+) strand; PAM type: YTN; PAM sequence: TTT
ataatgtttttaaattaaat

SEQ ID NO: 303451 - DNA, 20 bp, Artificial Sequence
  Description of Artificial Sequence: Synthetic oligonucleotide
  Target: ATXN1; (+) strand; PAM type: YTN; PAM sequence: TTA
taatgtttttaaattaaatt

SEQ ID NO: 303452 - DNA, 20 bp, Artificial Sequence
  Description of Artificial Sequence: Synthetic oligonucleotide
  Target: ATXN1; (+) strand; PAM type: YTN; PAM sequence: TTT
ttaaattaaattttaaaaac

SEQ ID NO: 303453 - DNA, 20 bp, Artificial Sequence
  Description of Artificial Sequence: Synthetic oligonucleotide
  Target: ATXN1; (+) strand; PAM type: YTN; PAM sequence: TTT
taaattaaattttaaaaact

SEQ ID NO: 303454 - DNA, 20 bp, Artificial Sequence
  Description of Artificial Sequence: Synthetic oligonucleotide
  Target: ATXN1; (+) strand; PAM type: YTN; PAM sequence: TTT
aaattaaattttaaaaactt

SEQ ID NO: 303455 - DNA, 20 bp, Artificial Sequence
  Description of Artificial Sequence: Synthetic oligonucleotide
  Target: ATXN1; (+) strand; PAM type: YTN; PAM sequence: TTA
aattaaattttaaaaactta

SEQ ID NO: 303456 - DNA, 20 bp, Artificial Sequence
  Description of Artificial Sequence: Synthetic oligonucleotide
  Target: ATXN1; (+) strand; PAM type: YTN; PAM sequence: TTA
aattttaaaaacttagaacc

SEQ ID NO: 303457 - DNA, 20 bp, Artificial Sequence
  Description of Artificial Sequence: Synthetic oligonucleotide
  Target: ATXN1; (+) strand; PAM type: YTN; PAM sequence: TTT
taaaaacttagaaccttcac

SEQ ID NO: 303458 - DNA, 20 bp, Artificial Sequence
  Description of Artificial Sequence: Synthetic oligonucleotide
  Target: ATXN1; (+) strand; PAM type: YTN; PAM sequence: TTT
aaaaacttagaaccttcaca

SEQ ID NO: 303459 - DNA, 20 bp, Artificial Sequence
  Description of Artificial Sequence: Synthetic oligonucleotide
  Target: ATXN1; (+) strand; PAM type: YTN; PAM sequence: TTA
aaaacttagaaccttcacac

SEQ ID NO: 303460 - DNA, 20 bp, Artificial Sequence
  Description of Artificial Sequence: Synthetic oligonucleotide
  Target: ATXN1; (+) strand; PAM type: YTN; PAM sequence: CTT
agaaccttcacacaaagaga

SEQ ID NO: 303461 - DNA, 20 bp, Artificial Sequence
  Description of Artificial Sequence: Synthetic oligonucleotide
  Target: ATXN1; (+) strand; PAM type: YTN; PAM sequence: TTA
gaaccttcacacaaagagaa

SEQ ID NO: 303462 - DNA, 20 bp, Artificial Sequence
  Description of Artificial Sequence: Synthetic oligonucleotide
  Target: ATXN1; (+) strand; PAM type: YTN; PAM sequence: CTT
cacacaaagagaactccaag

SEQ ID NO: 303463 - DNA, 20 bp, Artificial Sequence
  Description of Artificial Sequence: Synthetic oligonucleotide
  Target: ATXN1; (+) strand; PAM type: YTN; PAM sequence: TTC
acacaaagagaactccaagc

SEQ ID NO: 303464 - DNA, 20 bp, Artificial Sequence
  Description of Artificial Sequence: Synthetic oligonucleotide
  Target: ATXN1; (+) strand; PAM type: YTN; PAM sequence: CTC
caagcccaaagatttcactg

SEQ ID NO: 303465 - DNA, 20 bp, Artificial Sequence
  Description of Artificial Sequence: Synthetic oligonucleotide
  Target: ATXN1; (+) strand; PAM type: YTN; PAM sequence: TTT
cactgtggaatttcatcaat

SEQ ID NO: 303466 - DNA, 20 bp, Artificial Sequence
  Description of Artificial Sequence: Synthetic oligonucleotide
  Target: ATXN1; (+) strand; PAM type: YTN; PAM sequence: TTC
actgtggaatttcatcaatt

SEQ ID NO: 303467 - DNA, 20 bp, Artificial Sequence
  Description of Artificial Sequence: Synthetic oligonucleotide
  Target: ATXN1; (+) strand; PAM type: YTN; PAM sequence: CTG
tggaatttcatcaattttaa

SEQ ID NO: 303468 - DNA, 20 bp, Artificial Sequence
  Description of Artificial Sequence: Synthetic oligonucleotide
  Target: ATXN1; (+) strand; PAM type: YTN; PAM sequence: TTT
catcaattttaagaggaaag

SEQ ID NO: 303469 - DNA, 20 bp, Artificial Sequence
  Description of Artificial Sequence: Synthetic oligonucleotide
  Target: ATXN1; (+) strand; PAM type: YTN; PAM sequence: TTC
atcaattttaagaggaaaga

SEQ ID NO: 303470 - DNA, 20 bp, Artificial Sequence
  Description of Artificial Sequence: Synthetic oligonucleotide
  Target: ATXN1; (+) strand; PAM type: YTN; PAM sequence: TTT
taagaggaaagaaaatctta

SEQ ID NO: 303471 - DNA, 20 bp, Artificial Sequence
  Description of Artificial Sequence: Synthetic oligonucleotide
  Target: ATXN1; (+) strand; PAM type: YTN; PAM sequence: TTT
aagaggaaagaaaatcttac

SEQ ID NO: 303472 - DNA, 20 bp, Artificial Sequence
  Description of Artificial Sequence: Synthetic oligonucleotide
  Target: ATXN1; (+) strand; PAM type: YTN; PAM sequence: TTA
agaggaaagaaaatcttaca

SEQ ID NO: 303473 - DNA, 20 bp, Artificial Sequence
  Description of Artificial Sequence: Synthetic oligonucleotide
  Target: ATXN1; (+) strand; PAM type: YTN; PAM sequence: CTT
acataaattctttcagaaaa

SEQ ID NO: 303474 - DNA, 20 bp, Artificial Sequence
  Description of Artificial Sequence: Synthetic oligonucleotide
  Target: ATXN1; (+) strand; PAM type: YTN; PAM sequence: TTA
cataaattctttcagaaaat

SEQ ID NO: 303475 - DNA, 20 bp, Artificial Sequence
  Description of Artificial Sequence: Synthetic oligonucleotide
  Target: ATXN1; (+) strand; PAM type: YTN; PAM sequence: TTC
tttcagaaaatagtaaaaaa

SEQ ID NO: 303476 - DNA, 20 bp, Artificial Sequence
  Description of Artificial Sequence: Synthetic oligonucleotide
  Target: ATXN1; (+) strand; PAM type: YTN; PAM sequence: CTT
tcagaaaatagtaaaaaaca

SEQ ID NO: 303477 - DNA, 20 bp, Artificial Sequence
  Description of Artificial Sequence: Synthetic oligonucleotide
  Target: ATXN1; (+) strand; PAM type: YTN; PAM sequence: TTT
cagaaaatagtaaaaaacag

SEQ ID NO: 303478 - DNA, 20 bp, Artificial Sequence
  Description of Artificial Sequence: Synthetic oligonucleotide
  Target: ATXN1; (+) strand; PAM type: YTN; PAM sequence: TTC
agaaaatagtaaaaaacagg

SEQ ID NO: 303479 - DNA, 20 bp, Artificial Sequence
  Description of Artificial Sequence: Synthetic oligonucleotide
  Target: ATXN1; (+) strand; PAM type: YTN; PAM sequence: CTC
cacgaatacattttatataa

SEQ ID NO: 303480 - DNA, 20 bp, Artificial Sequence
  Description of Artificial Sequence: Synthetic oligonucleotide
  Target: ATXN1; (+) strand; PAM type: YTN; PAM sequence: TTT
tatataatcagtattactaa

SEQ ID NO: 303481 - DNA, 20 bp, Artificial Sequence
  Description of Artificial Sequence: Synthetic oligonucleotide
  Target: ATXN1; (+) strand; PAM type: YTN; PAM sequence: TTT
atataatcagtattactaac

SEQ ID NO: 303482 - DNA, 20 bp, Artificial Sequence
  Description of Artificial Sequence: Synthetic oligonucleotide
  Target: ATXN1; (+) strand; PAM type: YTN; PAM sequence: TTA
tataatcagtattactaaca

SEQ ID NO: 303483 - DNA, 20 bp, Artificial Sequence
  Description of Artificial Sequence: Synthetic oligonucleotide
  Target: ATXN1; (+) strand; PAM type: YTN; PAM sequence: TTA
ctaacactaacactaaaccc

SEQ ID NO: 303484 - DNA, 20 bp, Artificial Sequence
  Description of Artificial Sequence: Synthetic oligonucleotide
  Target: ATXN1; (+) strand; PAM type: YTN; PAM sequence: CTA
acactaacactaaaccctag

SEQ ID NO: 303485 - DNA, 20 bp, Artificial Sequence
  Description of Artificial Sequence: Synthetic oligonucleotide
  Target: ATXN1; (+) strand; PAM type: YTN; PAM sequence: CTA
acactaaaccctagtaaata

SEQ ID NO: 303486 - DNA, 20 bp, Artificial Sequence
  Description of Artificial Sequence: Synthetic oligonucleotide
  Target: ATXN1; (+) strand; PAM type: YTN; PAM sequence: CTA
aaccctagtaaatattatat

SEQ ID NO: 303487 - DNA, 20 bp, Artificial Sequence
  Description of Artificial Sequence: Synthetic oligonucleotide
  Target: ATXN1; (+) strand; PAM type: YTN; PAM sequence: CTA
gtaaatattatataaagaaa

SEQ ID NO: 303488 - DNA, 20 bp, Artificial Sequence
  Description of Artificial Sequence: Synthetic oligonucleotide
  Target: ATXN1; (+) strand; PAM type: YTN; PAM sequence: TTA
tataaagaaacaaaattaca

SEQ ID NO: 303489 - DNA, 20 bp, Artificial Sequence
  Description of Artificial Sequence: Synthetic oligonucleotide
  Target: ATXN1; (+) strand; PAM type: YTN; PAM sequence: TTA
cagaccaatgttcttaataa

SEQ ID NO: 303490 - DNA, 20 bp, Artificial Sequence
  Description of Artificial Sequence: Synthetic oligonucleotide
  Target: ATXN1; (+) strand; PAM type: YTN; PAM sequence: TTC
ttaataaacatagtcgcaaa

SEQ ID NO: 303491 - DNA, 20 bp, Artificial Sequence
  Description of Artificial Sequence: Synthetic oligonucleotide
  Target: ATXN1; (+) strand; PAM type: YTN; PAM sequence: CTT
aataaacatagtcgcaaaaa

SEQ ID NO: 303492 - DNA, 20 bp, Artificial Sequence
  Description of Artificial Sequence: Synthetic oligonucleotide
  Target: ATXN1; (+) strand; PAM type: YTN; PAM sequence: TTA
ataaacatagtcgcaaaaat

SEQ ID NO: 303493 - DNA, 20 bp, Artificial Sequence
  Description of Artificial Sequence: Synthetic oligonucleotide
  Target: ATXN1; (+) strand; PAM type: YTN; PAM sequence: CTT
aataaaatgttagccaaaat

SEQ ID NO: 303494 - DNA, 20 bp, Artificial Sequence
  Description of Artificial Sequence: Synthetic oligonucleotide
  Target: ATXN1; (+) strand; PAM type: YTN; PAM sequence: TTA
ataaaatgttagccaaaata

SEQ ID NO: 303495 - DNA, 20 bp, Artificial Sequence
  Description of Artificial Sequence: Synthetic oligonucleotide
  Target: ATXN1; (+) strand; PAM type: YTN; PAM sequence: TTA
gccaaaatatccagcaatag

SEQ ID NO: 303496 - DNA, 20 bp, Artificial Sequence
  Description of Artificial Sequence: Synthetic oligonucleotide
  Target: ATXN1; (+) strand; PAM type: YTN; PAM sequence: TTA
taactggttcttatcccagg

SEQ ID NO: 303497 - DNA, 20 bp, Artificial Sequence
  Description of Artificial Sequence: Synthetic oligonucleotide
  Target: ATXN1; (+) strand; PAM type: YTN; PAM sequence: CTG
gttcttatcccaggaactca

SEQ ID NO: 303498 - DNA, 20 bp, Artificial Sequence
  Description of Artificial Sequence: Synthetic oligonucleotide
  Target: ATXN1; (+) strand; PAM type: YTN; PAM sequence: TTC
ttatcccaggaactcaagtt

SEQ ID NO: 303499 - DNA, 20 bp, Artificial Sequence
  Description of Artificial Sequence: Synthetic oligonucleotide
  Target: ATXN1; (+) strand; PAM type: YTN; PAM sequence: CTT
atcccaggaactcaagtttg

SEQ ID NO: 303500 - DNA, 20 bp, Artificial Sequence
  Description of Artificial Sequence: Synthetic oligonucleotide
  Target: ATXN1; (+) strand; PAM type: YTN; PAM sequence: TTA
tcccaggaactcaagtttgg

SEQ ID NO: 303501 - DNA, 20 bp, Artificial Sequence
  Description of Artificial Sequence: Synthetic oligonucleotide
  Target: ATXN1; (+) strand; PAM type: YTN; PAM sequence: CTC
aagtttggtttaacacttaa

SEQ ID NO: 303502 - DNA, 20 bp, Artificial Sequence
  Description of Artificial Sequence: Synthetic oligonucleotide
  Target: ATXN1; (+) strand; PAM type: YTN; PAM sequence: TTT
ggtttaacacttaaaaccaa

SEQ ID NO: 303503 - DNA, 20 bp, Artificial Sequence
  Description of Artificial Sequence: Synthetic oligonucleotide
  Target: ATXN1; (+) strand; PAM type: YTN; PAM sequence: TTG
gtttaacacttaaaaccaat

SEQ ID NO: 303504 - DNA, 20 bp, Artificial Sequence
  Description of Artificial Sequence: Synthetic oligonucleotide
  Target: ATXN1; (+) strand; PAM type: YTN; PAM sequence: TTT
aacacttaaaaccaatcaat

SEQ ID NO: 303505 - DNA, 20 bp, Artificial Sequence
  Description of Artificial Sequence: Synthetic oligonucleotide
  Target: ATXN1; (+) strand; PAM type: YTN; PAM sequence: TTA
acacttaaaaccaatcaata

SEQ ID NO: 303506 - DNA, 20 bp, Artificial Sequence
  Description of Artificial Sequence: Synthetic oligonucleotide
  Target: ATXN1; (+) strand; PAM type: YTN; PAM sequence: CTT
aaaaccaatcaatataattc

SEQ ID NO: 303507 - DNA, 20 bp, Artificial Sequence
  Description of Artificial Sequence: Synthetic oligonucleotide
  Target: ATXN1; (+) strand; PAM type: YTN; PAM sequence: TTA
aaaccaatcaatataattca

SEQ ID NO: 303508 - DNA, 20 bp, Artificial Sequence
  Description of Artificial Sequence: Synthetic oligonucleotide
  Target: ATXN1; (+) strand; PAM type: YTN; PAM sequence: TTC
accacataaagcggaaaacc

SEQ ID NO: 303509 - DNA, 20 bp, Artificial Sequence
  Description of Artificial Sequence: Synthetic oligonucleotide
  Target: ATXN1; (+) strand; PAM type: YTN; PAM sequence: CTC
aacagaggcaaaaatgaact

SEQ ID NO: 303510 - DNA, 20 bp, Artificial Sequence
  Description of Artificial Sequence: Synthetic oligonucleotide
  Target: ATXN1; (+) strand; PAM type: YTN; PAM sequence: CTG
cacaaaattcaacacacatt

SEQ ID NO: 303511 - DNA, 20 bp, Artificial Sequence
  Description of Artificial Sequence: Synthetic oligonucleotide
  Target: ATXN1; (+) strand; PAM type: YTN; PAM sequence: TTC
aacacacattcccgataaaa

SEQ ID NO: 303512 - DNA, 20 bp, Artificial Sequence
  Description of Artificial Sequence: Synthetic oligonucleotide
  Target: ATXN1; (+) strand; PAM type: YTN; PAM sequence: TTC
ccgataaaaacaaacaaaca

SEQ ID NO: 303513 - DNA, 20 bp, Artificial Sequence
  Description of Artificial Sequence: Synthetic oligonucleotide
  Target: ATXN1; (+) strand; PAM type: YTN; PAM sequence: TTC
ttagaaaaaagagaatagaa

SEQ ID NO: 303514 - DNA, 20 bp, Artificial Sequence
  Description of Artificial Sequence: Synthetic oligonucleotide
  Target: ATXN1; (+) strand; PAM type: YTN; PAM sequence: CTT
agaaaaaagagaatagaagg

SEQ ID NO: 303515 - DNA, 20 bp, Artificial Sequence
  Description of Artificial Sequence: Synthetic oligonucleotide
  Target: ATXN1; (+) strand; PAM type: YTN; PAM sequence: TTA
gaaaaaagagaatagaagga

SEQ ID NO: 303516 - DNA, 20 bp, Artificial Sequence
  Description of Artificial Sequence: Synthetic oligonucleotide
  Target: ATXN1; (+) strand; PAM type: YTN; PAM sequence: CTT
cgtcaatccaataaaaggca

SEQ ID NO: 303517 - DNA, 20 bp, Artificial Sequence
  Description of Artificial Sequence: Synthetic oligonucleotide
  Target: ATXN1; (+) strand; PAM type: YTN; PAM sequence: TTC
gtcaatccaataaaaggcaa

SEQ ID NO: 303518 - DNA, 20 bp, Artificial Sequence
  Description of Artificial Sequence: Synthetic oligonucleotide
  Target: ATXN1; (+) strand; PAM type: YTN; PAM sequence: CTA
cagctaacatcatgatgaaa

SEQ ID NO: 303519 - DNA, 20 bp, Artificial Sequence
  Description of Artificial Sequence: Synthetic oligonucleotide
  Target: ATXN1; (+) strand; PAM type: YTN; PAM sequence: CTA
acatcatgatgaaatagtgg

SEQ ID NO: 303520 - DNA, 20 bp, Artificial Sequence
  Description of Artificial Sequence: Synthetic oligonucleotide
  Target: ATXN1; (+) strand; PAM type: YTN; PAM sequence: TTA
atactttccctgtacgatca

SEQ ID NO: 303521 - DNA, 20 bp, Artificial Sequence
  Description of Artificial Sequence: Synthetic oligonucleotide
  Target: ATXN1; (+) strand; PAM type: YTN; PAM sequence: CTT
tccctgtacgatcagaaaaa

SEQ ID NO: 303522 - DNA, 20 bp, Artificial Sequence
  Description of Artificial Sequence: Synthetic oligonucleotide
  Target: ATXN1; (+) strand; PAM type: YTN; PAM sequence: TTT
ccctgtacgatcagaaaaaa

SEQ ID NO: 303523 - DNA, 20 bp, Artificial Sequence
  Description of Artificial Sequence: Synthetic oligonucleotide
  Target: ATXN1; (+) strand; PAM type: YTN; PAM sequence: TTC
cctgtacgatcagaaaaaaa

SEQ ID NO: 303524 - DNA, 20 bp, Artificial Sequence
  Description of Artificial Sequence: Synthetic oligonucleotide
  Target: ATXN1; (+) strand; PAM type: YTN; PAM sequence: CTG
tacgatcagaaaaaaagtcc

SEQ ID NO: 303525 - DNA, 20 bp, Artificial Sequence
  Description of Artificial Sequence: Synthetic oligonucleotide
  Target: ATXN1; (+) strand; PAM type: YTN; PAM sequence: CTG
gttatataaataatttgaaa

SEQ ID NO: 303526 - DNA, 20 bp, Artificial Sequence
  Description of Artificial Sequence: Synthetic oligonucleotide
  Target: ATXN1; (+) strand; PAM type: YTN; PAM sequence: TTA
tataaataatttgaaaagga

SEQ ID NO: 303527 - DNA, 20 bp, Artificial Sequence
  Description of Artificial Sequence: Synthetic oligonucleotide
  Target: ATXN1; (+) strand; PAM type: YTN; PAM sequence: TTT
gaaaaggatgatttaaaaat

SEQ ID NO: 303528 - DNA, 20 bp, Artificial Sequence
  Description of Artificial Sequence: Synthetic oligonucleotide
  Target: ATXN1; (+) strand; PAM type: YTN; PAM sequence: TTG
aaaaggatgatttaaaaatt

SEQ ID NO: 303529 - DNA, 20 bp, Artificial Sequence
  Description of Artificial Sequence: Synthetic oligonucleotide
  Target: ATXN1; (+) strand; PAM type: YTN; PAM sequence: TTT
aaaaattacatgtattatat

SEQ ID NO: 303530 - DNA, 20 bp, Artificial Sequence
  Description of Artificial Sequence: Synthetic oligonucleotide
  Target: ATXN1; (+) strand; PAM type: YTN; PAM sequence: TTA
aaaattacatgtattatatc

SEQ ID NO: 303531 - DNA, 20 bp, Artificial Sequence
  Description of Artificial Sequence: Synthetic oligonucleotide
  Target: ATXN1; (+) strand; PAM type: YTN; PAM sequence: TTA
catgtattatatcgaaaagc

SEQ ID NO: 303532 - DNA, 20 bp, Artificial Sequence
  Description of Artificial Sequence: Synthetic oligonucleotide
  Target: ATXN1; (+) strand; PAM type: YTN; PAM sequence: TTA
tatcgaaaagcataaagtac

SEQ ID NO: 303533 - DNA, 20 bp, Artificial Sequence
  Description of Artificial Sequence: Synthetic oligonucleotide
  Target: ATXN1; (+) strand; PAM type: YTN; PAM sequence: TTA
aattttaccaaagatatgca

SEQ ID NO: 303534 - DNA, 20 bp, Artificial Sequence
  Description of Artificial Sequence: Synthetic oligonucleotide
  Target: ATXN1; (+) strand; PAM type: YTN; PAM sequence: TTT
taccaaagatatgcaatgtc

SEQ ID NO: 303535 - DNA, 20 bp, Artificial Sequence
  Description of Artificial Sequence: Synthetic oligonucleotide
  Target: ATXN1; (+) strand; PAM type: YTN; PAM sequence: TTT
accaaagatatgcaatgtct

SEQ ID NO: 303536 - DNA, 20 bp, Artificial Sequence
  Description of Artificial Sequence: Synthetic oligonucleotide
  Target: ATXN1; (+) strand; PAM type: YTN; PAM sequence: TTA
ccaaagatatgcaatgtctc

SEQ ID NO: 303537 - DNA, 20 bp, Artificial Sequence
  Description of Artificial Sequence: Synthetic oligonucleotide
  Target: ATXN1; (+) strand; PAM type: YTN; PAM sequence: CTC
tgcaggaaaaacagggaaac

SEQ ID NO: 303538 - DNA, 20 bp, Artificial Sequence
  Description of Artificial Sequence: Synthetic oligonucleotide
  Target: ATXN1; (+) strand; PAM type: YTN; PAM sequence: CTG
caggaaaaacagggaaacat

SEQ ID NO: 303539 - DNA, 20 bp, Artificial Sequence
  Description of Artificial Sequence: Synthetic oligonucleotide
  Target: ATXN1; (+) strand; PAM type: YTN; PAM sequence: TTC
ctggcagaaattcattaaaa

SEQ ID NO: 303540 - DNA, 20 bp, Artificial Sequence
  Description of Artificial Sequence: Synthetic oligonucleotide
  Target: ATXN1; (+) strand; PAM type: YTN; PAM sequence: CTG
gcagaaattcattaaaaagg

SEQ ID NO: 303541 - DNA, 20 bp, Artificial Sequence
  Description of Artificial Sequence: Synthetic oligonucleotide
  Target: ATXN1; (+) strand; PAM type: YTN; PAM sequence: TTC
attaaaaaggcagagaaaga

SEQ ID NO: 303542 - DNA, 20 bp, Artificial Sequence
  Description of Artificial Sequence: Synthetic oligonucleotide
  Target: ATXN1; (+) strand; PAM type: YTN; PAM sequence: TTA
aaaaggcagagaaagatata

SEQ ID NO: 303543 - DNA, 20 bp, Artificial Sequence
  Description of Artificial Sequence: Synthetic oligonucleotide
  Target: ATXN1; (+) strand; PAM type: YTN; PAM sequence: TTT
ttgaattgaagtttcaatat

SEQ ID NO: 303544 - DNA, 20 bp, Artificial Sequence
  Description of Artificial Sequence: Synthetic oligonucleotide
  Target: ATXN1; (+) strand; PAM type: YTN; PAM sequence: TTT
tgaattgaagtttcaatatt

SEQ ID NO: 303545 - DNA, 20 bp, Artificial Sequence
  Description of Artificial Sequence: Synthetic oligonucleotide
  Target: ATXN1; (+) strand; PAM type: YTN; PAM sequence: TTT
gaattgaagtttcaatattg

SEQ ID NO: 303546 - DNA, 20 bp, Artificial Sequence
  Description of Artificial Sequence: Synthetic oligonucleotide
  Target: ATXN1; (+) strand; PAM type: YTN; PAM sequence: TTG
aattgaagtttcaatattgt

SEQ ID NO: 303547 - DNA, 20 bp, Artificial Sequence
  Description of Artificial Sequence: Synthetic oligonucleotide
  Target: ATXN1; (+) strand; PAM type: YTN; PAM sequence: TTG
aagtttcaatattgttaagg

SEQ ID NO: 303548 - DNA, 20 bp, Artificial Sequence
  Description of Artificial Sequence: Synthetic oligonucleotide
  Target: ATXN1; (+) strand; PAM type: YTN; PAM sequence: TTT
caatattgttaaggtgaatt

SEQ ID NO: 303549 - DNA, 20 bp, Artificial Sequence
  Description of Artificial Sequence: Synthetic oligonucleotide
  Target: ATXN1; (+) strand; PAM type: YTN; PAM sequence: TTC
aatattgttaaggtgaattt

SEQ ID NO: 303550 - DNA, 20 bp, Artificial Sequence
  Description of Artificial Sequence: Synthetic oligonucleotide
  Target: ATXN1; (+) strand; PAM type: YTN; PAM sequence: TTG
ttaaggtgaattttccttaa

SEQ ID NO: 303551 - DNA, 20 bp, Artificial Sequence
  Description of Artificial Sequence: Synthetic oligonucleotide
  Target: ATXN1; (+) strand; PAM type: YTN; PAM sequence: TTA
aggtgaattttccttaaatt

SEQ ID NO: 303552 - DNA, 20 bp, Artificial Sequence
  Description of Artificial Sequence: Synthetic oligonucleotide
  Target: ATXN1; (+) strand; PAM type: YTN; PAM sequence: TTT
tccttaaatttctctcttat

SEQ ID NO: 303553 - DNA, 20 bp, Artificial Sequence
  Description of Artificial Sequence: Synthetic oligonucleotide
  Target: ATXN1; (+) strand; PAM type: YTN; PAM sequence: TTT
ccttaaatttctctcttatg

SEQ ID NO: 303554 - DNA, 20 bp, Artificial Sequence
  Description of Artificial Sequence: Synthetic oligonucleotide
  Target: ATXN1; (+) strand; PAM type: YTN; PAM sequence: TTC
cttaaatttctctcttatga

SEQ ID NO: 303555 - DNA, 20 bp, Artificial Sequence
  Description of Artificial Sequence: Synthetic oligonucleotide
  Target: ATXN1; (+) strand; PAM type: YTN; PAM sequence: CTT
aaatttctctcttatgattc

SEQ ID NO: 303556 - DNA, 20 bp, Artificial Sequence
  Description of Artificial Sequence: Synthetic oligonucleotide
  Target: ATXN1; (+) strand; PAM type: YTN; PAM sequence: TTA
aatttctctcttatgattca

SEQ ID NO: 303557 - DNA, 20 bp, Artificial Sequence
  Description of Artificial Sequence: Synthetic oligonucleotide
  Target: ATXN1; (+) strand; PAM type: YTN; PAM sequence: TTT
ctctcttatgattcagtgca

SEQ ID NO: 303558 - DNA, 20 bp, Artificial Sequence
  Description of Artificial Sequence: Synthetic oligonucleotide
  Target: ATXN1; (+) strand; PAM type: YTN; PAM sequence: TTC
tctcttatgattcagtgcaa

SEQ ID NO: 303559 - DNA, 20 bp, Artificial Sequence
  Description of Artificial Sequence: Synthetic oligonucleotide
  Target: ATXN1; (+) strand; PAM type: YTN; PAM sequence: CTC
tcttatgattcagtgcaatc

SEQ ID NO: 303560 - DNA, 20 bp, Artificial Sequence
  Description of Artificial Sequence: Synthetic oligonucleotide
  Target: ATXN1; (+) strand; PAM type: YTN; PAM sequence: CTC
ttatgattcagtgcaatctg

SEQ ID NO: 303561 - DNA, 20 bp, Artificial Sequence
  Description of Artificial Sequence: Synthetic oligonucleotide
  Target: ATXN1; (+) strand; PAM type: YTN; PAM sequence: CTT
atgattcagtgcaatctgaa

SEQ ID NO: 303562 - DNA, 20 bp, Artificial Sequence
  Description of Artificial Sequence: Synthetic oligonucleotide
  Target: ATXN1; (+) strand; PAM type: YTN; PAM sequence: TTA
tgattcagtgcaatctgaac

SEQ ID NO: 303563 - DNA, 20 bp, Artificial Sequence
  Description of Artificial Sequence: Synthetic oligonucleotide
  Target: ATXN1; (+) strand; PAM type: YTN; PAM sequence: TTC
agtgcaatctgaactaactt

SEQ ID NO: 303564 - DNA, 20 bp, Artificial Sequence
  Description of Artificial Sequence: Synthetic oligonucleotide
  Target: ATXN1; (+) strand; PAM type: YTN; PAM sequence: CTG
aactaacttctaacaggctt

SEQ ID NO: 303565 - DNA, 20 bp, Artificial Sequence
  Description of Artificial Sequence: Synthetic oligonucleotide
  Target: ATXN1; (+) strand; PAM type: YTN; PAM sequence: CTA
acttctaacaggcttttttg

SEQ ID NO: 303566 - DNA, 20 bp, Artificial Sequence
  Description of Artificial Sequence: Synthetic oligonucleotide
  Target: ATXN1; (+) strand; PAM type: YTN; PAM sequence: CTT
ctaacaggcttttttggggg

SEQ ID NO: 303567 - DNA, 20 bp, Artificial Sequence
  Description of Artificial Sequence: Synthetic oligonucleotide
  Target: ATXN1; (+) strand; PAM type: YTN; PAM sequence: TTC
taacaggcttttttgggggg

SEQ ID NO: 303568 - DNA, 20 bp, Artificial Sequence
  Description of Artificial Sequence: Synthetic oligonucleotide
  Target: ATXN1; (+) strand; PAM type: YTN; PAM sequence: CTA
acaggcttttttggggggta

SEQ ID NO: 303569 - DNA, 20 bp, Artificial Sequence
  Description of Artificial Sequence: Synthetic oligonucleotide
  Target: ATXN1; (+) strand; PAM type: YTN; PAM sequence: CTT
ttttggggggtagggggatt

SEQ ID NO: 303570 - DNA, 20 bp, Artificial Sequence
  Description of Artificial Sequence: Synthetic oligonucleotide
  Target: ATXN1; (+) strand; PAM type: YTN; PAM sequence: TTT
tttggggggtagggggattt

SEQ ID NO: 303571 - DNA, 20 bp, Artificial Sequence
  Description of Artificial Sequence: Synthetic oligonucleotide
  Target: ATXN1; (+) strand; PAM type: YTN; PAM sequence: TTT
ttggggggtagggggattta

SEQ ID NO: 303572 - DNA, 20 bp, Artificial Sequence
  Description of Artificial Sequence: Synthetic oligonucleotide
  Target: ATXN1; (+) strand; PAM type: YTN; PAM sequence: TTT
tggggggtagggggatttat

SEQ ID NO: 303573 - DNA, 20 bp, Artificial Sequence
  Description of Artificial Sequence: Synthetic oligonucleotide
  Target: ATXN1; (+) strand; PAM type: YTN; PAM sequence: TTT
ggggggtagggggatttata

SEQ ID NO: 303574 - DNA, 20 bp, Artificial Sequence
  Description of Artificial Sequence: Synthetic oligonucleotide
  Target: ATXN1; (+) strand; PAM type: YTN; PAM sequence: TTG
gggggtagggggatttatat

SEQ ID NO: 303575 - DNA, 20 bp, Artificial Sequence
  Description of Artificial Sequence: Synthetic oligonucleotide
  Target: ATXN1; (+) strand; PAM type: YTN; PAM sequence: TTT
atatggaactctgaaggaga

SEQ ID NO: 303576 - DNA, 20 bp, Artificial Sequence
  Description of Artificial Sequence: Synthetic oligonucleotide
  Target: ATXN1; (+) strand; PAM type: YTN; PAM sequence: TTA
tatggaactctgaaggagat

SEQ ID NO: 303577 - DNA, 20 bp, Artificial Sequence
  Description of Artificial Sequence: Synthetic oligonucleotide
  Target: ATXN1; (+) strand; PAM type: YTN; PAM sequence: CTC
tgaaggagatagaacaccac

SEQ ID NO: 303578 - DNA, 20 bp, Artificial Sequence
  Description of Artificial Sequence: Synthetic oligonucleotide
  Target: ATXN1; (+) strand; PAM type: YTN; PAM sequence: CTG
aaggagatagaacaccacca

SEQ ID NO: 303579 - DNA, 20 bp, Artificial Sequence
  Description of Artificial Sequence: Synthetic oligonucleotide
  Target: ATXN1; (+) strand; PAM type: YTN; PAM sequence: CTT
gagggaaaaaacaagacaga

SEQ ID NO: 303580 - DNA, 20 bp, Artificial Sequence
  Description of Artificial Sequence: Synthetic oligonucleotide
  Target: ATXN1; (+) strand; PAM type: YTN; PAM sequence: TTG
agggaaaaaacaagacagag

SEQ ID NO: 303581 - DNA, 20 bp, Artificial Sequence
  Description of Artificial Sequence: Synthetic oligonucleotide
  Target: ATXN1; (+) strand; PAM type: YTN; PAM sequence: CTC
acgctatctgttttcaagat

SEQ ID NO: 303582 - DNA, 20 bp, Artificial Sequence
  Description of Artificial Sequence: Synthetic oligonucleotide
  Target: ATXN1; (+) strand; PAM type: YTN; PAM sequence: CTA
tctgttttcaagatttacca

SEQ ID NO: 303583 - DNA, 20 bp, Artificial Sequence
  Description of Artificial Sequence: Synthetic oligonucleotide
  Target: ATXN1; (+) strand; PAM type: YTN; PAM sequence: CTG
ttttcaagatttaccataaa

SEQ ID NO: 303584 - DNA, 20 bp, Artificial Sequence
  Description of Artificial Sequence: Synthetic oligonucleotide
  Target: ATXN1; (+) strand; PAM type: YTN; PAM sequence: TTT
tcaagatttaccataaagct

SEQ ID NO: 303585 - DNA, 20 bp, Artificial Sequence
  Description of Artificial Sequence: Synthetic oligonucleotide
  Target: ATXN1; (+) strand; PAM type: YTN; PAM sequence: TTT
caagatttaccataaagcta

SEQ ID NO: 303586 - DNA, 20 bp, Artificial Sequence
  Description of Artificial Sequence: Synthetic oligonucleotide
  Target: ATXN1; (+) strand; PAM type: YTN; PAM sequence: TTC
aagatttaccataaagctat

SEQ ID NO: 303587 - DNA, 20 bp, Artificial Sequence
  Description of Artificial Sequence: Synthetic oligonucleotide
  Target: ATXN1; (+) strand; PAM type: YTN; PAM sequence: TTT
accataaagctatttagttt

SEQ ID NO: 303588 - DNA, 20 bp, Artificial Sequence
  Description of Artificial Sequence: Synthetic oligonucleotide
  Target: ATXN1; (+) strand; PAM type: YTN; PAM sequence: TTA
ccataaagctatttagtttt

SEQ ID NO: 303589 - DNA, 20 bp, Artificial Sequence
  Description of Artificial Sequence: Synthetic oligonucleotide
  Target: ATXN1; (+) strand; PAM type: YTN; PAM sequence: CTA
tttagtttttaattttaaca

SEQ ID NO: 303590 - DNA, 20 bp, Artificial Sequence
  Description of Artificial Sequence: Synthetic oligonucleotide
  Target: ATXN1; (+) strand; PAM type: YTN; PAM sequence: TTT
agtttttaattttaacattt

SEQ ID NO: 303591 - DNA, 20 bp, Artificial Sequence
  Description of Artificial Sequence: Synthetic oligonucleotide
  Target: ATXN1; (+) strand; PAM type: YTN; PAM sequence: TTA
gtttttaattttaacattta

SEQ ID NO: 303592 - DNA, 20 bp, Artificial Sequence
  Description of Artificial Sequence: Synthetic oligonucleotide
  Target: ATXN1; (+) strand; PAM type: YTN; PAM sequence: TTT
ttaattttaacatttattca

SEQ ID NO: 303593 - DNA, 20 bp, Artificial Sequence
  Description of Artificial Sequence: Synthetic oligonucleotide
  Target: ATXN1; (+) strand; PAM type: YTN; PAM sequence: TTT
taattttaacatttattcat

SEQ ID NO: 303594 - DNA, 20 bp, Artificial Sequence
  Description of Artificial Sequence: Synthetic oligonucleotide
  Target: ATXN1; (+) strand; PAM type: YTN; PAM sequence: TTT
aattttaacatttattcatt

SEQ ID NO: 303595 - DNA, 20 bp, Artificial Sequence
  Description of Artificial Sequence: Synthetic oligonucleotide
  Target: ATXN1; (+) strand; PAM type: YTN; PAM sequence: TTA
attttaacatttattcatta

SEQ ID NO: 303596 - DNA, 20 bp, Artificial Sequence
  Description of Artificial Sequence: Synthetic oligonucleotide
  Target: ATXN1; (+) strand; PAM type: YTN; PAM sequence: TTT
taacatttattcattatttt

SEQ ID NO: 303597 - DNA, 20 bp, Artificial Sequence
  Description of Artificial Sequence: Synthetic oligonucleotide
  Target: ATXN1; (+) strand; PAM type: YTN; PAM sequence: TTT
aacatttattcattattttt

SEQ ID NO: 303598 - DNA, 20 bp, Artificial Sequence
  Description of Artificial Sequence: Synthetic oligonucleotide
  Target: ATXN1; (+) strand; PAM type: YTN; PAM sequence: TTA
acatttattcattatttttg

SEQ ID NO: 303599 - DNA, 20 bp, Artificial Sequence
  Description of Artificial Sequence: Synthetic oligonucleotide
  Target: ATXN1; (+) strand; PAM type: YTN; PAM sequence: TTT
attcattatttttgaatttt

SEQ ID NO: 303600 - DNA, 20 bp, Artificial Sequence
  Description of Artificial Sequence: Synthetic oligonucleotide
  Target: ATXN1; (+) strand; PAM type: YTN; PAM sequence: TTA
ttcattatttttgaatttta

SEQ ID NO: 303601 - DNA, 20 bp, Artificial Sequence
  Description of Artificial Sequence: Synthetic oligonucleotide
  Target: ATXN1; (+) strand; PAM type: YTN; PAM sequence: TTC
attatttttgaattttattg

SEQ ID NO: 303602 - DNA, 20 bp, Artificial Sequence
  Description of Artificial Sequence: Synthetic oligonucleotide
  Target: ATXN1; (+) strand; PAM type: YTN; PAM sequence: TTA
tttttgaattttattgttat

SEQ ID NO: 303603 - DNA, 20 bp, Artificial Sequence
  Description of Artificial Sequence: Synthetic oligonucleotide
  Target: ATXN1; (+) strand; PAM type: YTN; PAM sequence: TTT
ttgaattttattgttattat

SEQ ID NO: 303604 - DNA, 20 bp, Artificial Sequence
  Description of Artificial Sequence: Synthetic oligonucleotide
  Target: ATXN1; (+) strand; PAM type: YTN; PAM sequence: TTT
tgaattttattgttattatt

SEQ ID NO: 303605 - DNA, 20 bp, Artificial Sequence
  Description of Artificial Sequence: Synthetic oligonucleotide
  Target: ATXN1; (+) strand; PAM type: YTN; PAM sequence: TTT
gaattttattgttattattt

SEQ ID NO: 303606 - DNA, 20 bp, Artificial Sequence
  Description of Artificial Sequence: Synthetic oligonucleotide
  Target: ATXN1; (+) strand; PAM type: YTN; PAM sequence: TTG
aattttattgttattatttt

SEQ ID NO: 303607 - DNA, 20 bp, Artificial Sequence
  Description of Artificial Sequence: Synthetic oligonucleotide
  Target: ATXN1; (+) strand; PAM type: YTN; PAM sequence: TTT
tattgttattatttttgaga

SEQ ID NO: 303608 - DNA, 20 bp, Artificial Sequence
  Description of Artificial Sequence: Synthetic oligonucleotide
  Target: ATXN1; (+) strand; PAM type: YTN; PAM sequence: TTT
attgttattatttttgagac

SEQ ID NO: 303609 - DNA, 20 bp, Artificial Sequence
  Description of Artificial Sequence: Synthetic oligonucleotide
  Target: ATXN1; (+) strand; PAM type: YTN; PAM sequence: TTA
ttgttattatttttgagaca

SEQ ID NO: 303610 - DNA, 20 bp, Artificial Sequence
  Description of Artificial Sequence: Synthetic oligonucleotide
  Target: ATXN1; (+) strand; PAM type: YTN; PAM sequence: TTG
ttattatttttgagacaggg

SEQ ID NO: 303611 - DNA, 20 bp, Artificial Sequence
  Description of Artificial Sequence: Synthetic oligonucleotide
  Target: ATXN1; (+) strand; PAM type: YTN; PAM sequence: TTA
ttatttttgagacagggtcc

SEQ ID NO: 303612 - DNA, 20 bp, Artificial Sequence
  Description of Artificial Sequence: Synthetic oligonucleotide
  Target: ATXN1; (+) strand; PAM type: YTN; PAM sequence: TTA
tttttgagacagggtccagc

SEQ ID NO: 303613 - DNA, 20 bp, Artificial Sequence
  Description of Artificial Sequence: Synthetic oligonucleotide
  Target: ATXN1; (+) strand; PAM type: YTN; PAM sequence: TTT
ttgagacagggtccagctca

SEQ ID NO: 303614 - DNA, 20 bp, Artificial Sequence
  Description of Artificial Sequence: Synthetic oligonucleotide
  Target: ATXN1; (+) strand; PAM type: YTN; PAM sequence: TTT
tgagacagggtccagctcag

SEQ ID NO: 303615 - DNA, 20 bp, Artificial Sequence
  Description of Artificial Sequence: Synthetic oligonucleotide
  Target: ATXN1; (+) strand; PAM type: YTN; PAM sequence: TTT
gagacagggtccagctcagt

SEQ ID NO: 303616 - DNA, 20 bp, Artificial Sequence
  Description of Artificial Sequence: Synthetic oligonucleotide
  Target: ATXN1; (+) strand; PAM type: YTN; PAM sequence: TTG
agacagggtccagctcagtc

SEQ ID NO: 303617 - DNA, 20 bp, Artificial Sequence
  Description of Artificial Sequence: Synthetic oligonucleotide
  Target: ATXN1; (+) strand; PAM type: YTN; PAM sequence: CTC
agtcacccaggccggagtgc

SEQ ID NO: 303618 - DNA, 20 bp, Artificial Sequence
  Description of Artificial Sequence: Synthetic oligonucleotide
  Target: ATXN1; (+) strand; PAM type: YTN; PAM sequence: CTC
actgtagcctcaacctcctg

SEQ ID NO: 303619 - DNA, 20 bp, Artificial Sequence
  Description of Artificial Sequence: Synthetic oligonucleotide
  Target: ATXN1; (+) strand; PAM type: YTN; PAM sequence: CTG
tagcctcaacctcctgggct

SEQ ID NO: 303620 - DNA, 20 bp, Artificial Sequence
  Description of Artificial Sequence: Synthetic oligonucleotide
  Target: ATXN1; (+) strand; PAM type: YTN; PAM sequence: CTC
aacctcctgggctcaagcga

SEQ ID NO: 303621 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagcgatcctcc

SEQ ID NO: 303622 - DNA, 20 bp, Artificial Sequence
  Description of Artificial Sequence: Synthetic oligonucleotide
  Target: ATXN1; (+) strand; PAM type: YTN; PAM sequence: CTG
ggctcaagcgatcctcccac

SEQ ID NO: 303623 - DNA, 20 bp, Artificial Sequence
  Description of Artificial Sequence: Synthetic oligonucleotide
  Target: ATXN1; (+) strand; PAM type: YTN; PAM sequence: CTC
aagcgatcctcccacctcag

SEQ ID NO: 303624 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcctcaccagta

SEQ ID NO: 303625 - DNA, 20 bp, Artificial Sequence
  Description of Artificial Sequence: Synthetic oligonucleotide
  Target: ATXN1; (+) strand; PAM type: YTN; PAM sequence: CTC
agcctcaccagtagatggga

SEQ ID NO: 303626 - DNA, 20 bp, Artificial Sequence
  Description of Artificial Sequence: Synthetic oligonucleotide
  Target: ATXN1; (+) strand; PAM type: YTN; PAM sequence: CTC
accagtagatgggactacag

SEQ ID NO: 303627 - DNA, 20 bp, Artificial Sequence
  Description of Artificial Sequence: Synthetic oligonucleotide
  Target: ATXN1; (+) strand; PAM type: YTN; PAM sequence: CTA
caggcacatgccacctcacc

SEQ ID NO: 303628 - DNA, 20 bp, Artificial Sequence
  Description of Artificial Sequence: Synthetic oligonucleotide
  Target: ATXN1; (+) strand; PAM type: YTN; PAM sequence: CTC
acccagctgatttttgtatt

SEQ ID NO: 303629 - DNA, 20 bp, Artificial Sequence
  Description of Artificial Sequence: Synthetic oligonucleotide
  Target: ATXN1; (+) strand; PAM type: YTN; PAM sequence: CTG
atttttgtatttttagtaga

SEQ ID NO: 303630 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 303631 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 303632 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 303633 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 303634 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggttttg

SEQ ID NO: 303635 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggttttgc

SEQ ID NO: 303636 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggttttgct

SEQ ID NO: 303637 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggttttgcta

SEQ ID NO: 303638 - DNA, 20 bp, Artificial Sequence
  Description of Artificial Sequence: Synthetic oligonucleotide
  Target: ATXN1; (+) strand; PAM type: YTN; PAM sequence: TTT
tgctatgctgcccaggctgg

SEQ ID NO: 303639 - DNA, 20 bp, Artificial Sequence
  Description of Artificial Sequence: Synthetic oligonucleotide
  Target: ATXN1; (+) strand; PAM type: YTN; PAM sequence: TTT
gctatgctgcccaggctggt

SEQ ID NO: 303640 - DNA, 20 bp, Artificial Sequence
  Description of Artificial Sequence: Synthetic oligonucleotide
  Target: ATXN1; (+) strand; PAM type: YTN; PAM sequence: TTG
ctatgctgcccaggctggtc

SEQ ID NO: 303641 - DNA, 20 bp, Artificial Sequence
  Description of Artificial Sequence: Synthetic oligonucleotide
  Target: ATXN1; (+) strand; PAM type: YTN; PAM sequence: CTA
tgctgcccaggctggtctca

SEQ ID NO: 303642 - DNA, 20 bp, Artificial Sequence
  Description of Artificial Sequence: Synthetic oligonucleotide
  Target: ATXN1; (+) strand; PAM type: YTN; PAM sequence: CTG
cccaggctggtctcaaactc

SEQ ID NO: 303643 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgagctca

SEQ ID NO: 303644 - DNA, 20 bp, Artificial Sequence
  Description of Artificial Sequence: Synthetic oligonucleotide
  Target: ATXN1; (+) strand; PAM type: YTN; PAM sequence: CTC
aaactcctgagctcaagcaa

SEQ ID NO: 303645 - DNA, 20 bp, Artificial Sequence
  Description of Artificial Sequence: Synthetic oligonucleotide
  Target: ATXN1; (+) strand; PAM type: YTN; PAM sequence: CTC
ctgagctcaagcaatctttc

SEQ ID NO: 303646 - DNA, 20 bp, Artificial Sequence
  Description of Artificial Sequence: Synthetic oligonucleotide
  Target: ATXN1; (+) strand; PAM type: YTN; PAM sequence: CTG
agctcaagcaatctttctgc

SEQ ID NO: 303647 - DNA, 20 bp, Artificial Sequence
  Description of Artificial Sequence: Synthetic oligonucleotide
  Target: ATXN1; (+) strand; PAM type: YTN; PAM sequence: CTC
aagcaatctttctgcctcgg

SEQ ID NO: 303648 - DNA, 20 bp, Artificial Sequence
  Description of Artificial Sequence: Synthetic oligonucleotide
  Target: ATXN1; (+) strand; PAM type: YTN; PAM sequence: CTT
tctgcctcggcctcccaaag

SEQ ID NO: 303649 - DNA, 20 bp, Artificial Sequence
  Description of Artificial Sequence: Synthetic oligonucleotide
  Target: ATXN1; (+) strand; PAM type: YTN; PAM sequence: TTT
ctgcctcggcctcccaaagt

SEQ ID NO: 303650 - DNA, 20 bp, Artificial Sequence
  Description of Artificial Sequence: Synthetic oligonucleotide
  Target: ATXN1; (+) strand; PAM type: YTN; PAM sequence: TTC
tgcctcggcctcccaaagta

SEQ ID NO: 303651 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcccaaagtact

SEQ ID NO: 303652 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtactggga

SEQ ID NO: 303653 - DNA, 20 bp, Artificial Sequence
  Description of Artificial Sequence: Synthetic oligonucleotide
  Target: ATXN1; (+) strand; PAM type: YTN; PAM sequence: CTC
ccaaagtactgggattacag

SEQ ID NO: 303654 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgagccac

SEQ ID NO: 303655 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccaccacacc

SEQ ID NO: 303656 - DNA, 20 bp, Artificial Sequence
  Description of Artificial Sequence: Synthetic oligonucleotide
  Target: ATXN1; (+) strand; PAM type: YTN; PAM sequence: CTA
ttattattatttttaataga

SEQ ID NO: 303657 - DNA, 20 bp, Artificial Sequence
  Description of Artificial Sequence: Synthetic oligonucleotide
  Target: ATXN1; (+) strand; PAM type: YTN; PAM sequence: TTA
ttattatttttaatagagac

SEQ ID NO: 303658 - DNA, 20 bp, Artificial Sequence
  Description of Artificial Sequence: Synthetic oligonucleotide
  Target: ATXN1; (+) strand; PAM type: YTN; PAM sequence: TTA
ttatttttaatagagacacg

SEQ ID NO: 303659 - DNA, 20 bp, Artificial Sequence
  Description of Artificial Sequence: Synthetic oligonucleotide
  Target: ATXN1; (+) strand; PAM type: YTN; PAM sequence: TTA
tttttaatagagacacggtc

SEQ ID NO: 303660 - DNA, 20 bp, Artificial Sequence
  Description of Artificial Sequence: Synthetic oligonucleotide
  Target: ATXN1; (+) strand; PAM type: YTN; PAM sequence: TTT
ttaatagagacacggtctca

SEQ ID NO: 303661 - DNA, 20 bp, Artificial Sequence
  Description of Artificial Sequence: Synthetic oligonucleotide
  Target: ATXN1; (+) strand; PAM type: YTN; PAM sequence: TTT
taatagagacacggtctcac

SEQ ID NO: 303662 - DNA, 20 bp, Artificial Sequence
  Description of Artificial Sequence: Synthetic oligonucleotide
  Target: ATXN1; (+) strand; PAM type: YTN; PAM sequence: TTT
aatagagacacggtctcact

SEQ ID NO: 303663 - DNA, 20 bp, Artificial Sequence
  Description of Artificial Sequence: Synthetic oligonucleotide
  Target: ATXN1; (+) strand; PAM type: YTN; PAM sequence: TTA
atagagacacggtctcactc

SEQ ID NO: 303664 - DNA, 20 bp, Artificial Sequence
  Description of Artificial Sequence: Synthetic oligonucleotide
  Target: ATXN1; (+) strand; PAM type: YTN; PAM sequence: CTC
actctgctgcccaggatgga

SEQ ID NO: 303665 - DNA, 20 bp, Artificial Sequence
  Description of Artificial Sequence: Synthetic oligonucleotide
  Target: ATXN1; (+) strand; PAM type: YTN; PAM sequence: CTC
tgctgcccaggatggaatgc

SEQ ID NO: 303666 - DNA, 20 bp, Artificial Sequence
  Description of Artificial Sequence: Synthetic oligonucleotide
  Target: ATXN1; (+) strand; PAM type: YTN; PAM sequence: CTG
ctgcccaggatggaatgcaa

SEQ ID NO: 303667 - DNA, 20 bp, Artificial Sequence
  Description of Artificial Sequence: Synthetic oligonucleotide
  Target: ATXN1; (+) strand; PAM type: YTN; PAM sequence: CTG
cccaggatggaatgcaatgc

SEQ ID NO: 303668 - DNA, 20 bp, Artificial Sequence
  Description of Artificial Sequence: Synthetic oligonucleotide
  Target: ATXN1; (+) strand; PAM type: YTN; PAM sequence: CTG
cagtcactgtagcctcaaac

SEQ ID NO: 303669 - DNA, 20 bp, Artificial Sequence
  Description of Artificial Sequence: Synthetic oligonucleotide
  Target: ATXN1; (+) strand; PAM type: YTN; PAM sequence: CTG
tagcctcaaactcctgggcc

SEQ ID NO: 303670 - DNA, 20 bp, Artificial Sequence
  Description of Artificial Sequence: Synthetic oligonucleotide
  Target: ATXN1; (+) strand; PAM type: YTN; PAM sequence: CTC
aaactcctgggcccaagcga

SEQ ID NO: 303671 - DNA, 20 bp, Artificial Sequence
  Description of Artificial Sequence: Synthetic oligonucleotide
  Target: ATXN1; (+) strand; PAM type: YTN; PAM sequence: CTC
ctgggcccaagcgatcctcc

SEQ ID NO: 303672 - DNA, 20 bp, Artificial Sequence
  Description of Artificial Sequence: Synthetic oligonucleotide
  Target: ATXN1; (+) strand; PAM type: YTN; PAM sequence: CTG
ggcccaagcgatcctcccac

SEQ ID NO: 303673 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcctcccaaggt

SEQ ID NO: 303674 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaggtgctggga

SEQ ID NO: 303675 - DNA, 20 bp, Artificial Sequence
  Description of Artificial Sequence: Synthetic oligonucleotide
  Target: ATXN1; (+) strand; PAM type: YTN; PAM sequence: CTC
ccaaggtgctgggattacag

SEQ ID NO: 303676 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcaagagccat

SEQ ID NO: 303677 - DNA, 20 bp, Artificial Sequence
  Description of Artificial Sequence: Synthetic oligonucleotide
  Target: ATXN1; (+) strand; PAM type: YTN; PAM sequence: TTA
caggcaagagccatagagcc

SEQ ID NO: 303678 - DNA, 20 bp, Artificial Sequence
  Description of Artificial Sequence: Synthetic oligonucleotide
  Target: ATXN1; (+) strand; PAM type: YTN; PAM sequence: TTT
taatcaagacaatatagtat

SEQ ID NO: 303679 - DNA, 20 bp, Artificial Sequence
  Description of Artificial Sequence: Synthetic oligonucleotide
  Target: ATXN1; (+) strand; PAM type: YTN; PAM sequence: TTT
aatcaagacaatatagtatt

SEQ ID NO: 303680 - DNA, 20 bp, Artificial Sequence
  Description of Artificial Sequence: Synthetic oligonucleotide
  Target: ATXN1; (+) strand; PAM type: YTN; PAM sequence: TTA
atcaagacaatatagtattg

SEQ ID NO: 303681 - DNA, 20 bp, Artificial Sequence
  Description of Artificial Sequence: Synthetic oligonucleotide
  Target: ATXN1; (+) strand; PAM type: YTN; PAM sequence: TTG
acctaagtacagactgcaga

SEQ ID NO: 303682 - DNA, 20 bp, Artificial Sequence
  Description of Artificial Sequence: Synthetic oligonucleotide
  Target: ATXN1; (+) strand; PAM type: YTN; PAM sequence: CTA
agtacagactgcagatcagt

SEQ ID NO: 303683 - DNA, 20 bp, Artificial Sequence
  Description of Artificial Sequence: Synthetic oligonucleotide
  Target: ATXN1; (+) strand; PAM type: YTN; PAM sequence: CTG
cagatcagtggaacagagag

SEQ ID NO: 303684 - DNA, 20 bp, Artificial Sequence
  Description of Artificial Sequence: Synthetic oligonucleotide
  Target: ATXN1; (+) strand; PAM type: YTN; PAM sequence: CTT
aaaacacatataaaaccaaa

SEQ ID NO: 303685 - DNA, 20 bp, Artificial Sequence
  Description of Artificial Sequence: Synthetic oligonucleotide
  Target: ATXN1; (+) strand; PAM type: YTN; PAM sequence: TTA
aaacacatataaaaccaaat

SEQ ID NO: 303686 - DNA, 20 bp, Artificial Sequence
  Description of Artificial Sequence: Synthetic oligonucleotide
  Target: ATXN1; (+) strand; PAM type: YTN; PAM sequence: TTT
ttgacaaaggtgtgatggca

SEQ ID NO: 303687 - DNA, 20 bp, Artificial Sequence
  Description of Artificial Sequence: Synthetic oligonucleotide
  Target: ATXN1; (+) strand; PAM type: YTN; PAM sequence: TTT
tgacaaaggtgtgatggcaa

SEQ ID NO: 303688 - DNA, 20 bp, Artificial Sequence
  Description of Artificial Sequence: Synthetic oligonucleotide
  Target: ATXN1; (+) strand; PAM type: YTN; PAM sequence: TTT
gacaaaggtgtgatggcaat

SEQ ID NO: 303689 - DNA, 20 bp, Artificial Sequence
  Description of Artificial Sequence: Synthetic oligonucleotide
  Target: ATXN1; (+) strand; PAM type: YTN; PAM sequence: TTG
acaaaggtgtgatggcaatt

SEQ ID NO: 303690 - DNA, 20 bp, Artificial Sequence
  Description of Artificial Sequence: Synthetic oligonucleotide
  Target: ATXN1; (+) strand; PAM type: YTN; PAM sequence: TTT
cataaggaaaaaaaatcact

SEQ ID NO: 303691 - DNA, 20 bp, Artificial Sequence
  Description of Artificial Sequence: Synthetic oligonucleotide
  Target: ATXN1; (+) strand; PAM type: YTN; PAM sequence: TTC
ataaggaaaaaaaatcactt

SEQ ID NO: 303692 - DNA, 20 bp, Artificial Sequence
  Description of Artificial Sequence: Synthetic oligonucleotide
  Target: ATXN1; (+) strand; PAM type: YTN; PAM sequence: CTT
caataattgttgtttcatac

SEQ ID NO: 303693 - DNA, 20 bp, Artificial Sequence
  Description of Artificial Sequence: Synthetic oligonucleotide
  Target: ATXN1; (+) strand; PAM type: YTN; PAM sequence: TTC
aataattgttgtttcataca

SEQ ID NO: 303694 - DNA, 20 bp, Artificial Sequence
  Description of Artificial Sequence: Synthetic oligonucleotide
  Target: ATXN1; (+) strand; PAM type: YTN; PAM sequence: TTG
ttgtttcatacattttaata

SEQ ID NO: 303695 - DNA, 20 bp, Artificial Sequence
  Description of Artificial Sequence: Synthetic oligonucleotide
  Target: ATXN1; (+) strand; PAM type: YTN; PAM sequence: TTG
tttcatacattttaataaaa

SEQ ID NO: 303696 - DNA, 20 bp, Artificial Sequence
  Description of Artificial Sequence: Synthetic oligonucleotide
  Target: ATXN1; (+) strand; PAM type: YTN; PAM sequence: TTT
catacattttaataaaaact

SEQ ID NO: 303697 - DNA, 20 bp, Artificial Sequence
  Description of Artificial Sequence: Synthetic oligonucleotide
  Target: ATXN1; (+) strand; PAM type: YTN; PAM sequence: TTC
atacattttaataaaaactg

SEQ ID NO: 303698 - DNA, 20 bp, Artificial Sequence
  Description of Artificial Sequence: Synthetic oligonucleotide
  Target: ATXN1; (+) strand; PAM type: YTN; PAM sequence: TTT
taataaaaactgaatcttga

SEQ ID NO: 303699 - DNA, 20 bp, Artificial Sequence
  Description of Artificial Sequence: Synthetic oligonucleotide
  Target: ATXN1; (+) strand; PAM type: YTN; PAM sequence: TTT
aataaaaactgaatcttgac

SEQ ID NO: 303700 - DNA, 20 bp, Artificial Sequence
  Description of Artificial Sequence: Synthetic oligonucleotide
  Target: ATXN1; (+) strand; PAM type: YTN; PAM sequence: TTA
ataaaaactgaatcttgacc

SEQ ID NO: 303701 - DNA, 20 bp, Artificial Sequence
  Description of Artificial Sequence: Synthetic oligonucleotide
  Target: ATXN1; (+) strand; PAM type: YTN; PAM sequence: CTG
aatcttgacccctacacctc

SEQ ID NO: 303702 - DNA, 20 bp, Artificial Sequence
  Description of Artificial Sequence: Synthetic oligonucleotide
  Target: ATXN1; (+) strand; PAM type: YTN; PAM sequence: CTT
gacccctacacctcatatct

SEQ ID NO: 303703 - DNA, 20 bp, Artificial Sequence
  Description of Artificial Sequence: Synthetic oligonucleotide
  Target: ATXN1; (+) strand; PAM type: YTN; PAM sequence: TTG
acccctacacctcatatctt

SEQ ID NO: 303704 - DNA, 20 bp, Artificial Sequence
  Description of Artificial Sequence: Synthetic oligonucleotide
  Target: ATXN1; (+) strand; PAM type: YTN; PAM sequence: CTA
cacctcatatcttaatttga

SEQ ID NO: 303705 - DNA, 20 bp, Artificial Sequence
  Description of Artificial Sequence: Synthetic oligonucleotide
  Target: ATXN1; (+) strand; PAM type: YTN; PAM sequence: CTC
atatcttaatttgaaatggc

SEQ ID NO: 303706 - DNA, 20 bp, Artificial Sequence
  Description of Artificial Sequence: Synthetic oligonucleotide
  Target: ATXN1; (+) strand; PAM type: YTN; PAM sequence: CTT
aatttgaaatggctcatata

SEQ ID NO: 303707 - DNA, 20 bp, Artificial Sequence
  Description of Artificial Sequence: Synthetic oligonucleotide
  Target: ATXN1; (+) strand; PAM type: YTN; PAM sequence: TTA
atttgaaatggctcatatac

SEQ ID NO: 303708 - DNA, 20 bp, Artificial Sequence
  Description of Artificial Sequence: Synthetic oligonucleotide
  Target: ATXN1; (+) strand; PAM type: YTN; PAM sequence: TTT
gaaatggctcatatacttaa

SEQ ID NO: 303709 - DNA, 20 bp, Artificial Sequence
  Description of Artificial Sequence: Synthetic oligonucleotide
  Target: ATXN1; (+) strand; PAM type: YTN; PAM sequence: TTG
aaatggctcatatacttaaa

SEQ ID NO: 303710 - DNA, 20 bp, Artificial Sequence
  Description of Artificial Sequence: Synthetic oligonucleotide
  Target: ATXN1; (+) strand; PAM type: YTN; PAM sequence: CTC
atatacttaaatgttaaggc

SEQ ID NO: 303711 - DNA, 20 bp, Artificial Sequence
  Description of Artificial Sequence: Synthetic oligonucleotide
  Target: ATXN1; (+) strand; PAM type: YTN; PAM sequence: CTT
aaatgttaaggctaaactag

SEQ ID NO: 303712 - DNA, 20 bp, Artificial Sequence
  Description of Artificial Sequence: Synthetic oligonucleotide
  Target: ATXN1; (+) strand; PAM type: YTN; PAM sequence: TTA
aatgttaaggctaaactaga

SEQ ID NO: 303713 - DNA, 20 bp, Artificial Sequence
  Description of Artificial Sequence: Synthetic oligonucleotide
  Target: ATXN1; (+) strand; PAM type: YTN; PAM sequence: TTA
aggctaaactagaaatcttc

SEQ ID NO: 303714 - DNA, 20 bp, Artificial Sequence
  Description of Artificial Sequence: Synthetic oligonucleotide
  Target: ATXN1; (+) strand; PAM type: YTN; PAM sequence: CTA
aactagaaatcttccaggag

SEQ ID NO: 303715 - DNA, 20 bp, Artificial Sequence
  Description of Artificial Sequence: Synthetic oligonucleotide
  Target: ATXN1; (+) strand; PAM type: YTN; PAM sequence: CTA
gaaatcttccaggagaaaac

SEQ ID NO: 303716 - DNA, 20 bp, Artificial Sequence
  Description of Artificial Sequence: Synthetic oligonucleotide
  Target: ATXN1; (+) strand; PAM type: YTN; PAM sequence: CTT
ccaggagaaaacaggaggat

SEQ ID NO: 303717 - DNA, 20 bp, Artificial Sequence
  Description of Artificial Sequence: Synthetic oligonucleotide
  Target: ATXN1; (+) strand; PAM type: YTN; PAM sequence: TTC
caggagaaaacaggaggata

SEQ ID NO: 303718 - DNA, 20 bp, Artificial Sequence
  Description of Artificial Sequence: Synthetic oligonucleotide
  Target: ATXN1; (+) strand; PAM type: YTN; PAM sequence: CTT
agcaaccacagggtaagcaa

SEQ ID NO: 303719 - DNA, 20 bp, Artificial Sequence
  Description of Artificial Sequence: Synthetic oligonucleotide
  Target: ATXN1; (+) strand; PAM type: YTN; PAM sequence: TTA
gcaaccacagggtaagcaaa

SEQ ID NO: 303720 - DNA, 20 bp, Artificial Sequence
  Description of Artificial Sequence: Synthetic oligonucleotide
  Target: ATXN1; (+) strand; PAM type: YTN; PAM sequence: TTA
taaagacacaaaaagcatat

SEQ ID NO: 303721 - DNA, 20 bp, Artificial Sequence
  Description of Artificial Sequence: Synthetic oligonucleotide
  Target: ATXN1; (+) strand; PAM type: YTN; PAM sequence: CTT
aaaaaatgataaattagact

SEQ ID NO: 303722 - DNA, 20 bp, Artificial Sequence
  Description of Artificial Sequence: Synthetic oligonucleotide
  Target: ATXN1; (+) strand; PAM type: YTN; PAM sequence: TTA
aaaaatgataaattagactt

SEQ ID NO: 303723 - DNA, 20 bp, Artificial Sequence
  Description of Artificial Sequence: Synthetic oligonucleotide
  Target: ATXN1; (+) strand; PAM type: YTN; PAM sequence: TTA
gacttcattaaaatttaaag

SEQ ID NO: 303724 - DNA, 20 bp, Artificial Sequence
  Description of Artificial Sequence: Synthetic oligonucleotide
  Target: ATXN1; (+) strand; PAM type: YTN; PAM sequence: CTT
cattaaaatttaaaggggct

SEQ ID NO: 303725 - DNA, 20 bp, Artificial Sequence
  Description of Artificial Sequence: Synthetic oligonucleotide
  Target: ATXN1; (+) strand; PAM type: YTN; PAM sequence: TTC
attaaaatttaaaggggctc

SEQ ID NO: 303726 - DNA, 20 bp, Artificial Sequence
  Description of Artificial Sequence: Synthetic oligonucleotide
  Target: ATXN1; (+) strand; PAM type: YTN; PAM sequence: TTA
aaatttaaaggggctcatca

SEQ ID NO: 303727 - DNA, 20 bp, Artificial Sequence
  Description of Artificial Sequence: Synthetic oligonucleotide
  Target: ATXN1; (+) strand; PAM type: YTN; PAM sequence: TTT
aaaggggctcatcaaacaca

SEQ ID NO: 303728 - DNA, 20 bp, Artificial Sequence
  Description of Artificial Sequence: Synthetic oligonucleotide
  Target: ATXN1; (+) strand; PAM type: YTN; PAM sequence: TTA
aaggggctcatcaaacacag

SEQ ID NO: 303729 - DNA, 20 bp, Artificial Sequence
  Description of Artificial Sequence: Synthetic oligonucleotide
  Target: ATXN1; (+) strand; PAM type: YTN; PAM sequence: CTC
atcaaacacagtttaaaaaa

SEQ ID NO: 303730 - DNA, 20 bp, Artificial Sequence
  Description of Artificial Sequence: Synthetic oligonucleotide
  Target: ATXN1; (+) strand; PAM type: YTN; PAM sequence: TTT
aaaaaatgaaaaaggtaagc

SEQ ID NO: 303731 - DNA, 20 bp, Artificial Sequence
  Description of Artificial Sequence: Synthetic oligonucleotide
  Target: ATXN1; (+) strand; PAM type: YTN; PAM sequence: TTA
aaaaatgaaaaaggtaagcc

SEQ ID NO: 303732 - DNA, 20 bp, Artificial Sequence
  Description of Artificial Sequence: Synthetic oligonucleotide
  Target: ATXN1; (+) strand; PAM type: YTN; PAM sequence: CTG
agaaaaaattcatatttctg

SEQ ID NO: 303733 - DNA, 20 bp, Artificial Sequence
  Description of Artificial Sequence: Synthetic oligonucleotide
  Target: ATXN1; (+) strand; PAM type: YTN; PAM sequence: TTC
atatttctgataaatgactt

SEQ ID NO: 303734 - DNA, 20 bp, Artificial Sequence
  Description of Artificial Sequence: Synthetic oligonucleotide
  Target: ATXN1; (+) strand; PAM type: YTN; PAM sequence: TTT
ctgataaatgacttaaatcc

SEQ ID NO: 303735 - DNA, 20 bp, Artificial Sequence
  Description of Artificial Sequence: Synthetic oligonucleotide
  Target: ATXN1; (+) strand; PAM type: YTN; PAM sequence: TTC
tgataaatgacttaaatcca

SEQ ID NO: 303736 - DNA, 20 bp, Artificial Sequence
  Description of Artificial Sequence: Synthetic oligonucleotide
  Target: ATXN1; (+) strand; PAM type: YTN; PAM sequence: CTG
ataaatgacttaaatccaga

SEQ ID NO: 303737 - DNA, 20 bp, Artificial Sequence
  Description of Artificial Sequence: Synthetic oligonucleotide
  Target: ATXN1; (+) strand; PAM type: YTN; PAM sequence: CTT
aaatccagactatataaaga

SEQ ID NO: 303738 - DNA, 20 bp, Artificial Sequence
  Description of Artificial Sequence: Synthetic oligonucleotide
  Target: ATXN1; (+) strand; PAM type: YTN; PAM sequence: TTA
aatccagactatataaagaa

SEQ ID NO: 303739 - DNA, 20 bp, Artificial Sequence
  Description of Artificial Sequence: Synthetic oligonucleotide
  Target: ATXN1; (+) strand; PAM type: YTN; PAM sequence: CTA
tataaagaactcatatatat

SEQ ID NO: 303740 - DNA, 20 bp, Artificial Sequence
  Description of Artificial Sequence: Synthetic oligonucleotide
  Target: ATXN1; (+) strand; PAM type: YTN; PAM sequence: CTC
atatatatacacatatatat

SEQ ID NO: 303741 - DNA, 20 bp, Artificial Sequence
  Description of Artificial Sequence: Synthetic oligonucleotide
  Target: ATXN1; (+) strand; PAM type: YTN; PAM sequence: TTC
acaaaataaaaaaaaaaacc

SEQ ID NO: 303742 - DNA, 20 bp, Artificial Sequence
  Description of Artificial Sequence: Synthetic oligonucleotide
  Target: ATXN1; (+) strand; PAM type: YTN; PAM sequence: CTA
tatctatatagatatagatt

SEQ ID NO: 303743 - DNA, 20 bp, Artificial Sequence
  Description of Artificial Sequence: Synthetic oligonucleotide
  Target: ATXN1; (+) strand; PAM type: YTN; PAM sequence: CTA
tatagatatagattgtttgt

SEQ ID NO: 303744 - DNA, 20 bp, Artificial Sequence
  Description of Artificial Sequence: Synthetic oligonucleotide
  Target: ATXN1; (+) strand; PAM type: YTN; PAM sequence: TTG
tttgttttgcgacacatcat

SEQ ID NO: 303745 - DNA, 20 bp, Artificial Sequence
  Description of Artificial Sequence: Synthetic oligonucleotide
  Target: ATXN1; (+) strand; PAM type: YTN; PAM sequence: TTT
gttttgcgacacatcattct

SEQ ID NO: 303746 - DNA, 20 bp, Artificial Sequence
  Description of Artificial Sequence: Synthetic oligonucleotide
  Target: ATXN1; (+) strand; PAM type: YTN; PAM sequence: TTG
ttttgcgacacatcattctg

SEQ ID NO: 303747 - DNA, 20 bp, Artificial Sequence
  Description of Artificial Sequence: Synthetic oligonucleotide
  Target: ATXN1; (+) strand; PAM type: YTN; PAM sequence: TTT
tgcgacacatcattctgttg

SEQ ID NO: 303748 - DNA, 20 bp, Artificial Sequence
  Description of Artificial Sequence: Synthetic oligonucleotide
  Target: ATXN1; (+) strand; PAM type: YTN; PAM sequence: TTT
gcgacacatcattctgttgc

SEQ ID NO: 303749 - DNA, 20 bp, Artificial Sequence
  Description of Artificial Sequence: Synthetic oligonucleotide
  Target: ATXN1; (+) strand; PAM type: YTN; PAM sequence: TTG
cgacacatcattctgttgcc

SEQ ID NO: 303750 - DNA, 20 bp, Artificial Sequence
  Description of Artificial Sequence: Synthetic oligonucleotide
  Target: ATXN1; (+) strand; PAM type: YTN; PAM sequence: TTC
tgttgcccaggctggaagtg

SEQ ID NO: 303751 - DNA, 20 bp, Artificial Sequence
  Description of Artificial Sequence: Synthetic oligonucleotide
  Target: ATXN1; (+) strand; PAM type: YTN; PAM sequence: CTG
ttgcccaggctggaagtgca

SEQ ID NO: 303752 - DNA, 20 bp, Artificial Sequence
  Description of Artificial Sequence: Synthetic oligonucleotide
  Target: ATXN1; (+) strand; PAM type: YTN; PAM sequence: TTG
cccaggctggaagtgcagtg

SEQ ID NO: 303753 - DNA, 20 bp, Artificial Sequence
  Description of Artificial Sequence: Synthetic oligonucleotide
  Target: ATXN1; (+) strand; PAM type: YTN; PAM sequence: CTG
gaagtgcagtggcaccatca

SEQ ID NO: 303754 - DNA, 20 bp, Artificial Sequence
  Description of Artificial Sequence: Synthetic oligonucleotide
  Target: ATXN1; (+) strand; PAM type: YTN; PAM sequence: CTC
actgcaggcttgacccctcc

SEQ ID NO: 303755 - DNA, 20 bp, Artificial Sequence
  Description of Artificial Sequence: Synthetic oligonucleotide
  Target: ATXN1; (+) strand; PAM type: YTN; PAM sequence: CTG
caggcttgacccctcccagg

SEQ ID NO: 303756 - DNA, 20 bp, Artificial Sequence
  Description of Artificial Sequence: Synthetic oligonucleotide
  Target: ATXN1; (+) strand; PAM type: YTN; PAM sequence: CTT
gacccctcccaggctcaagt

SEQ ID NO: 303757 - DNA, 20 bp, Artificial Sequence
  Description of Artificial Sequence: Synthetic oligonucleotide
  Target: ATXN1; (+) strand; PAM type: YTN; PAM sequence: TTG
acccctcccaggctcaagtg

SEQ ID NO: 303758 - DNA, 20 bp, Artificial Sequence
  Description of Artificial Sequence: Synthetic oligonucleotide
  Target: ATXN1; (+) strand; PAM type: YTN; PAM sequence: CTC
ccaggctcaagtgatcctcc

SEQ ID NO: 303759 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcccacctcag

SEQ ID NO: 303760 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcctcctgagta

SEQ ID NO: 303761 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtatctggga

SEQ ID NO: 303762 - DNA, 20 bp, Artificial Sequence
  Description of Artificial Sequence: Synthetic oligonucleotide
  Target: ATXN1; (+) strand; PAM type: YTN; PAM sequence: CTC
ctgagtatctgggattacag

SEQ ID NO: 303763 - DNA, 20 bp, Artificial Sequence
  Description of Artificial Sequence: Synthetic oligonucleotide
  Target: ATXN1; (+) strand; PAM type: YTN; PAM sequence: CTG
agtatctgggattacaggtg

SEQ ID NO: 303764 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgcgtgccac

SEQ ID NO: 303765 - DNA, 20 bp, Artificial Sequence
  Description of Artificial Sequence: Synthetic oligonucleotide
  Target: ATXN1; (+) strand; PAM type: YTN; PAM sequence: TTA
caggtgcgtgccactgctgc

SEQ ID NO: 303766 - DNA, 20 bp, Artificial Sequence
  Description of Artificial Sequence: Synthetic oligonucleotide
  Target: ATXN1; (+) strand; PAM type: YTN; PAM sequence: CTG
ctgccgcctagtttttgtat

SEQ ID NO: 303767 - DNA, 20 bp, Artificial Sequence
  Description of Artificial Sequence: Synthetic oligonucleotide
  Target: ATXN1; (+) strand; PAM type: YTN; PAM sequence: CTG
ccgcctagtttttgtatttt

SEQ ID NO: 303768 - DNA, 20 bp, Artificial Sequence
  Description of Artificial Sequence: Synthetic oligonucleotide
  Target: ATXN1; (+) strand; PAM type: YTN; PAM sequence: CTA
gtttttgtatttttaataga

SEQ ID NO: 303769 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttaatagagaca

SEQ ID NO: 303770 - DNA, 20 bp, Artificial Sequence
  Description of Artificial Sequence: Synthetic oligonucleotide
  Target: ATXN1; (+) strand; PAM type: YTN; PAM sequence: TTT
tgtatttttaatagagacag

SEQ ID NO: 303771 - DNA, 20 bp, Artificial Sequence
  Description of Artificial Sequence: Synthetic oligonucleotide
  Target: ATXN1; (+) strand; PAM type: YTN; PAM sequence: TTT
gtatttttaatagagacagg

SEQ ID NO: 303772 - DNA, 20 bp, Artificial Sequence
  Description of Artificial Sequence: Synthetic oligonucleotide
  Target: ATXN1; (+) strand; PAM type: YTN; PAM sequence: TTG
tatttttaatagagacaggg

SEQ ID NO: 303773 - DNA, 20 bp, Artificial Sequence
  Description of Artificial Sequence: Synthetic oligonucleotide
  Target: ATXN1; (+) strand; PAM type: YTN; PAM sequence: TTT
ttaatagagacagggtttca

SEQ ID NO: 303774 - DNA, 20 bp, Artificial Sequence
  Description of Artificial Sequence: Synthetic oligonucleotide
  Target: ATXN1; (+) strand; PAM type: YTN; PAM sequence: TTT
taatagagacagggtttcac

SEQ ID NO: 303775 - DNA, 20 bp, Artificial Sequence
  Description of Artificial Sequence: Synthetic oligonucleotide
  Target: ATXN1; (+) strand; PAM type: YTN; PAM sequence: TTT
aatagagacagggtttcacc

SEQ ID NO: 303776 - DNA, 20 bp, Artificial Sequence
  Description of Artificial Sequence: Synthetic oligonucleotide
  Target: ATXN1; (+) strand; PAM type: YTN; PAM sequence: TTA
atagagacagggtttcacca

SEQ ID NO: 303777 - DNA, 20 bp, Artificial Sequence
  Description of Artificial Sequence: Synthetic oligonucleotide
  Target: ATXN1; (+) strand; PAM type: YTN; PAM sequence: TTT
caccatgttgcccaggctga

SEQ ID NO: 303778 - DNA, 20 bp, Artificial Sequence
  Description of Artificial Sequence: Synthetic oligonucleotide
  Target: ATXN1; (+) strand; PAM type: YTN; PAM sequence: TTC
accatgttgcccaggctgat

SEQ ID NO: 303779 - DNA, 20 bp, Artificial Sequence
  Description of Artificial Sequence: Synthetic oligonucleotide
  Target: ATXN1; (+) strand; PAM type: YTN; PAM sequence: TTG
cccaggctgatctcgaactt

SEQ ID NO: 303780 - DNA, 20 bp, Artificial Sequence
  Description of Artificial Sequence: Synthetic oligonucleotide
  Target: ATXN1; (+) strand; PAM type: YTN; PAM sequence: CTG
atctcgaacttctagactca

SEQ ID NO: 303781 - DNA, 20 bp, Artificial Sequence
  Description of Artificial Sequence: Synthetic oligonucleotide
  Target: ATXN1; (+) strand; PAM type: YTN; PAM sequence: CTC
gaacttctagactcaagcaa

SEQ ID NO: 303782 - DNA, 20 bp, Artificial Sequence
  Description of Artificial Sequence: Synthetic oligonucleotide
  Target: ATXN1; (+) strand; PAM type: YTN; PAM sequence: CTT
ctagactcaagcaatatgcc

SEQ ID NO: 303783 - DNA, 20 bp, Artificial Sequence
  Description of Artificial Sequence: Synthetic oligonucleotide
  Target: ATXN1; (+) strand; PAM type: YTN; PAM sequence: TTC
tagactcaagcaatatgcct

SEQ ID NO: 303784 - DNA, 20 bp, Artificial Sequence
  Description of Artificial Sequence: Synthetic oligonucleotide
  Target: ATXN1; (+) strand; PAM type: YTN; PAM sequence: CTA
gactcaagcaatatgcctgc

SEQ ID NO: 303785 - DNA, 20 bp, Artificial Sequence
  Description of Artificial Sequence: Synthetic oligonucleotide
  Target: ATXN1; (+) strand; PAM type: YTN; PAM sequence: CTC
aagcaatatgcctgccttgg

SEQ ID NO: 303786 - DNA, 20 bp, Artificial Sequence
  Description of Artificial Sequence: Synthetic oligonucleotide
  Target: ATXN1; (+) strand; PAM type: YTN; PAM sequence: CTG
ccttggcctctggctagcat

SEQ ID NO: 303787 - DNA, 20 bp, Artificial Sequence
  Description of Artificial Sequence: Synthetic oligonucleotide
  Target: ATXN1; (+) strand; PAM type: YTN; PAM sequence: CTT
ggcctctggctagcattttt

SEQ ID NO: 303788 - DNA, 20 bp, Artificial Sequence
  Description of Artificial Sequence: Synthetic oligonucleotide
  Target: ATXN1; (+) strand; PAM type: YTN; PAM sequence: TTG
gcctctggctagcatttttt

SEQ ID NO: 303789 - DNA, 20 bp, Artificial Sequence
  Description of Artificial Sequence: Synthetic oligonucleotide
  Target: ATXN1; (+) strand; PAM type: YTN; PAM sequence: CTC
tggctagcattttttaaatt

SEQ ID NO: 303790 - DNA, 20 bp, Artificial Sequence
  Description of Artificial Sequence: Synthetic oligonucleotide
  Target: ATXN1; (+) strand; PAM type: YTN; PAM sequence: CTG
gctagcattttttaaattaa

SEQ ID NO: 303791 - DNA, 20 bp, Artificial Sequence
  Description of Artificial Sequence: Synthetic oligonucleotide
  Target: ATXN1; (+) strand; PAM type: YTN; PAM sequence: CTA
gcattttttaaattaactgt

SEQ ID NO: 303792 - DNA, 20 bp, Artificial Sequence
  Description of Artificial Sequence: Synthetic oligonucleotide
  Target: ATXN1; (+) strand; PAM type: YTN; PAM sequence: TTT
tttaaattaactgttgctac

SEQ ID NO: 303793 - DNA, 20 bp, Artificial Sequence
  Description of Artificial Sequence: Synthetic oligonucleotide
  Target: ATXN1; (+) strand; PAM type: YTN; PAM sequence: TTT
ttaaattaactgttgctacc

SEQ ID NO: 303794 - DNA, 20 bp, Artificial Sequence
  Description of Artificial Sequence: Synthetic oligonucleotide
  Target: ATXN1; (+) strand; PAM type: YTN; PAM sequence: TTT
taaattaactgttgctacct

SEQ ID NO: 303795 - DNA, 20 bp, Artificial Sequence
  Description of Artificial Sequence: Synthetic oligonucleotide
  Target: ATXN1; (+) strand; PAM type: YTN; PAM sequence: TTT
aaattaactgttgctacctg

SEQ ID NO: 303796 - DNA, 20 bp, Artificial Sequence
  Description of Artificial Sequence: Synthetic oligonucleotide
  Target: ATXN1; (+) strand; PAM type: YTN; PAM sequence: TTA
aattaactgttgctacctgc

SEQ ID NO: 303797 - DNA, 20 bp, Artificial Sequence
  Description of Artificial Sequence: Synthetic oligonucleotide
  Target: ATXN1; (+) strand; PAM type: YTN; PAM sequence: TTA
actgttgctacctgcaacaa

SEQ ID NO: 303798 - DNA, 20 bp, Artificial Sequence
  Description of Artificial Sequence: Synthetic oligonucleotide
  Target: ATXN1; (+) strand; PAM type: YTN; PAM sequence: CTG
ttgctacctgcaacaataca

SEQ ID NO: 303799 - DNA, 20 bp, Artificial Sequence
  Description of Artificial Sequence: Synthetic oligonucleotide
  Target: ATXN1; (+) strand; PAM type: YTN; PAM sequence: TTG
ctacctgcaacaatacagat

SEQ ID NO: 303800 - DNA, 20 bp, Artificial Sequence
  Description of Artificial Sequence: Synthetic oligonucleotide
  Target: ATXN1; (+) strand; PAM type: YTN; PAM sequence: CTA
cctgcaacaatacagatgat

SEQ ID NO: 303801 - DNA, 20 bp, Artificial Sequence
  Description of Artificial Sequence: Synthetic oligonucleotide
  Target: ATXN1; (+) strand; PAM type: YTN; PAM sequence: CTG
caacaatacagatgatctca

SEQ ID NO: 303802 - DNA, 20 bp, Artificial Sequence
  Description of Artificial Sequence: Synthetic oligonucleotide
  Target: ATXN1; (+) strand; PAM type: YTN; PAM sequence: CTC
aaaaatgatatgctgaacaa

SEQ ID NO: 303803 - DNA, 20 bp, Artificial Sequence
  Description of Artificial Sequence: Synthetic oligonucleotide
  Target: ATXN1; (+) strand; PAM type: YTN; PAM sequence: CTG
aacaaaagaaagcagatacg

SEQ ID NO: 303804 - DNA, 20 bp, Artificial Sequence
  Description of Artificial Sequence: Synthetic oligonucleotide
  Target: ATXN1; (+) strand; PAM type: YTN; PAM sequence: CTG
actgattccatttgtatgaa

SEQ ID NO: 303805 - DNA, 20 bp, Artificial Sequence
  Description of Artificial Sequence: Synthetic oligonucleotide
  Target: ATXN1; (+) strand; PAM type: YTN; PAM sequence: CTG
attccatttgtatgaagctc

SEQ ID NO: 303806 - DNA, 20 bp, Artificial Sequence
  Description of Artificial Sequence: Synthetic oligonucleotide
  Target: ATXN1; (+) strand; PAM type: YTN; PAM sequence: TTC
catttgtatgaagctcaaga

SEQ ID NO: 303807 - DNA, 20 bp, Artificial Sequence
  Description of Artificial Sequence: Synthetic oligonucleotide
  Target: ATXN1; (+) strand; PAM type: YTN; PAM sequence: TTT
gtatgaagctcaagaacaaa

SEQ ID NO: 303808 - DNA, 20 bp, Artificial Sequence
  Description of Artificial Sequence: Synthetic oligonucleotide
  Target: ATXN1; (+) strand; PAM type: YTN; PAM sequence: TTG
tatgaagctcaagaacaaac

SEQ ID NO: 303809 - DNA, 20 bp, Artificial Sequence
  Description of Artificial Sequence: Synthetic oligonucleotide
  Target: ATXN1; (+) strand; PAM type: YTN; PAM sequence: CTC
aagaacaaacaaaattcaat

SEQ ID NO: 303810 - DNA, 20 bp, Artificial Sequence
  Description of Artificial Sequence: Synthetic oligonucleotide
  Target: ATXN1; (+) strand; PAM type: YTN; PAM sequence: TTC
aattacagtgacagaaatca

SEQ ID NO: 303811 - DNA, 20 bp, Artificial Sequence
  Description of Artificial Sequence: Synthetic oligonucleotide
  Target: ATXN1; (+) strand; PAM type: YTN; PAM sequence: TTA
cagtgacagaaatcaaagca

SEQ ID NO: 303812 - DNA, 20 bp, Artificial Sequence
  Description of Artificial Sequence: Synthetic oligonucleotide
  Target: ATXN1; (+) strand; PAM type: YTN; PAM sequence: TTG
atgacggggaggtggaaagt

SEQ ID NO: 303813 - DNA, 20 bp, Artificial Sequence
  Description of Artificial Sequence: Synthetic oligonucleotide
  Target: ATXN1; (+) strand; PAM type: YTN; PAM sequence: TTG
acaggaagggggcagagggg

SEQ ID NO: 303814 - DNA, 20 bp, Artificial Sequence
  Description of Artificial Sequence: Synthetic oligonucleotide
  Target: ATXN1; (+) strand; PAM type: YTN; PAM sequence: CTC
tggggtgatggaaatgtccc

SEQ ID NO: 303815 - DNA, 20 bp, Artificial Sequence
  Description of Artificial Sequence: Synthetic oligonucleotide
  Target: ATXN1; (+) strand; PAM type: YTN; PAM sequence: CTG
gggtgatggaaatgtcccat

SEQ ID NO: 303816 - DNA, 20 bp, Artificial Sequence
  Description of Artificial Sequence: Synthetic oligonucleotide
  Target: ATXN1; (+) strand; PAM type: YTN; PAM sequence: CTT
gattaggatgctgattatgt

SEQ ID NO: 303817 - DNA, 20 bp, Artificial Sequence
  Description of Artificial Sequence: Synthetic oligonucleotide
  Target: ATXN1; (+) strand; PAM type: YTN; PAM sequence: TTG
attaggatgctgattatgtg

SEQ ID NO: 303818 - DNA, 20 bp, Artificial Sequence
  Description of Artificial Sequence: Synthetic oligonucleotide
  Target: ATXN1; (+) strand; PAM type: YTN; PAM sequence: TTA
ggatgctgattatgtggatg

SEQ ID NO: 303819 - DNA, 20 bp, Artificial Sequence
  Description of Artificial Sequence: Synthetic oligonucleotide
  Target: ATXN1; (+) strand; PAM type: YTN; PAM sequence: CTG
attatgtggatgtatgcatt

SEQ ID NO: 303820 - DNA, 20 bp, Artificial Sequence
  Description of Artificial Sequence: Synthetic oligonucleotide
  Target: ATXN1; (+) strand; PAM type: YTN; PAM sequence: TTA
tgtggatgtatgcattcatc

SEQ ID NO: 303821 - DNA, 20 bp, Artificial Sequence
  Description of Artificial Sequence: Synthetic oligonucleotide
  Target: ATXN1; (+) strand; PAM type: YTN; PAM sequence: TTC
atcaaaactcattgcgctgt

SEQ ID NO: 303822 - DNA, 20 bp, Artificial Sequence
  Description of Artificial Sequence: Synthetic oligonucleotide
  Target: ATXN1; (+) strand; PAM type: YTN; PAM sequence: CTC
attgcgctgtacgcttaaga

SEQ ID NO: 303823 - DNA, 20 bp, Artificial Sequence
  Description of Artificial Sequence: Synthetic oligonucleotide
  Target: ATXN1; (+) strand; PAM type: YTN; PAM sequence: TTG
cgctgtacgcttaagatgtg

SEQ ID NO: 303824 - DNA, 20 bp, Artificial Sequence
  Description of Artificial Sequence: Synthetic oligonucleotide
  Target: ATXN1; (+) strand; PAM type: YTN; PAM sequence: CTG
tacgcttaagatgtgttgat

SEQ ID NO: 303825 - DNA, 20 bp, Artificial Sequence
  Description of Artificial Sequence: Synthetic oligonucleotide
  Target: ATXN1; (+) strand; PAM type: YTN; PAM sequence: CTT
aagatgtgttgatttcactg

SEQ ID NO: 303826 - DNA, 20 bp, Artificial Sequence
  Description of Artificial Sequence: Synthetic oligonucleotide
  Target: ATXN1; (+) strand; PAM type: YTN; PAM sequence: TTA
agatgtgttgatttcactgt

SEQ ID NO: 303827 - DNA, 20 bp, Artificial Sequence
  Description of Artificial Sequence: Synthetic oligonucleotide
  Target: ATXN1; (+) strand; PAM type: YTN; PAM sequence: TTG
atttcactgtatgttctccc

SEQ ID NO: 303828 - DNA, 20 bp, Artificial Sequence
  Description of Artificial Sequence: Synthetic oligonucleotide
  Target: ATXN1; (+) strand; PAM type: YTN; PAM sequence: TTT
cactgtatgttctccctaaa

SEQ ID NO: 303829 - DNA, 20 bp, Artificial Sequence
  Description of Artificial Sequence: Synthetic oligonucleotide
  Target: ATXN1; (+) strand; PAM type: YTN; PAM sequence: TTC
actgtatgttctccctaaat

SEQ ID NO: 303830 - DNA, 20 bp, Artificial Sequence
  Description of Artificial Sequence: Synthetic oligonucleotide
  Target: ATXN1; (+) strand; PAM type: YTN; PAM sequence: CTG
tatgttctccctaaatagaa

SEQ ID NO: 303831 - DNA, 20 bp, Artificial Sequence
  Description of Artificial Sequence: Synthetic oligonucleotide
  Target: ATXN1; (+) strand; PAM type: YTN; PAM sequence: TTC
tccctaaatagaaactaatt

SEQ ID NO: 303832 - DNA, 20 bp, Artificial Sequence
  Description of Artificial Sequence: Synthetic oligonucleotide
  Target: ATXN1; (+) strand; PAM type: YTN; PAM sequence: CTC
cctaaatagaaactaattta

SEQ ID NO: 303833 - DNA, 20 bp, Artificial Sequence
  Description of Artificial Sequence: Synthetic oligonucleotide
  Target: ATXN1; (+) strand; PAM type: YTN; PAM sequence: CTA
aatagaaactaatttattag

SEQ ID NO: 303834 - DNA, 20 bp, Artificial Sequence
  Description of Artificial Sequence: Synthetic oligonucleotide
  Target: ATXN1; (+) strand; PAM type: YTN; PAM sequence: CTA
atttattagtgaaaagaaag

SEQ ID NO: 303835 - DNA, 20 bp, Artificial Sequence
  Description of Artificial Sequence: Synthetic oligonucleotide
  Target: ATXN1; (+) strand; PAM type: YTN; PAM sequence: TTT
attagtgaaaagaaagatgt

SEQ ID NO: 303836 - DNA, 20 bp, Artificial Sequence
  Description of Artificial Sequence: Synthetic oligonucleotide
  Target: ATXN1; (+) strand; PAM type: YTN; PAM sequence: TTA
ttagtgaaaagaaagatgta

SEQ ID NO: 303837 - DNA, 20 bp, Artificial Sequence
  Description of Artificial Sequence: Synthetic oligonucleotide
  Target: ATXN1; (+) strand; PAM type: YTN; PAM sequence: TTA
gtgaaaagaaagatgtactt

SEQ ID NO: 303838 - DNA, 20 bp, Artificial Sequence
  Description of Artificial Sequence: Synthetic oligonucleotide
  Target: ATXN1; (+) strand; PAM type: YTN; PAM sequence: CTT
tcttttcactattaataata

SEQ ID NO: 303839 - DNA, 20 bp, Artificial Sequence
  Description of Artificial Sequence: Synthetic oligonucleotide
  Target: ATXN1; (+) strand; PAM type: YTN; PAM sequence: TTT
cttttcactattaataataa

SEQ ID NO: 303840 - DNA, 20 bp, Artificial Sequence
  Description of Artificial Sequence: Synthetic oligonucleotide
  Target: ATXN1; (+) strand; PAM type: YTN; PAM sequence: TTC
ttttcactattaataataaa

SEQ ID NO: 303841 - DNA, 20 bp, Artificial Sequence
  Description of Artificial Sequence: Synthetic oligonucleotide
  Target: ATXN1; (+) strand; PAM type: YTN; PAM sequence: CTT
ttcactattaataataaact

SEQ ID NO: 303842 - DNA, 20 bp, Artificial Sequence
  Description of Artificial Sequence: Synthetic oligonucleotide
  Target: ATXN1; (+) strand; PAM type: YTN; PAM sequence: TTT
tcactattaataataaacta

SEQ ID NO: 303843 - DNA, 20 bp, Artificial Sequence
  Description of Artificial Sequence: Synthetic oligonucleotide
  Target: ATXN1; (+) strand; PAM type: YTN; PAM sequence: TTT
cactattaataataaactaa

SEQ ID NO: 303844 - DNA, 20 bp, Artificial Sequence
  Description of Artificial Sequence: Synthetic oligonucleotide
  Target: ATXN1; (+) strand; PAM type: YTN; PAM sequence: TTC
actattaataataaactaat

SEQ ID NO: 303845 - DNA, 20 bp, Artificial Sequence
  Description of Artificial Sequence: Synthetic oligonucleotide
  Target: ATXN1; (+) strand; PAM type: YTN; PAM sequence: CTA
ttaataataaactaatttat

SEQ ID NO: 303846 - DNA, 20 bp, Artificial Sequence
  Description of Artificial Sequence: Synthetic oligonucleotide
  Target: ATXN1; (+) strand; PAM type: YTN; PAM sequence: TTA
ataataaactaatttattag

SEQ ID NO: 303847 - DNA, 20 bp, Artificial Sequence
  Description of Artificial Sequence: Synthetic oligonucleotide
  Target: ATXN1; (+) strand; PAM type: YTN; PAM sequence: CTA
atttattagtgaaaagaaag

SEQ ID NO: 303848 - DNA, 20 bp, Artificial Sequence
  Description of Artificial Sequence: Synthetic oligonucleotide
  Target: ATXN1; (+) strand; PAM type: YTN; PAM sequence: TTT
attagtgaaaagaaagatgt

SEQ ID NO: 303849 - DNA, 20 bp, Artificial Sequence
  Description of Artificial Sequence: Synthetic oligonucleotide
  Target: ATXN1; (+) strand; PAM type: YTN; PAM sequence: TTA
ttagtgaaaagaaagatgta

SEQ ID NO: 303850 - DNA, 20 bp, Artificial Sequence
  Description of Artificial Sequence: Synthetic oligonucleotide
  Target: ATXN1; (+) strand; PAM type: YTN; PAM sequence: TTA
gtgaaaagaaagatgtactt

SEQ ID NO: 303851 - DNA, 20 bp, Artificial Sequence
  Description of Artificial Sequence: Synthetic oligonucleotide
  Target: ATXN1; (+) strand; PAM type: YTN; PAM sequence: CTT
tctacctggagggtctgtgg

SEQ ID NO: 303852 - DNA, 20 bp, Artificial Sequence
  Description of Artificial Sequence: Synthetic oligonucleotide
  Target: ATXN1; (+) strand; PAM type: YTN; PAM sequence: TTT
ctacctggagggtctgtggg

SEQ ID NO: 303853 - DNA, 20 bp, Artificial Sequence
  Description of Artificial Sequence: Synthetic oligonucleotide
  Target: ATXN1; (+) strand; PAM type: YTN; PAM sequence: TTC
tacctggagggtctgtgggg

SEQ ID NO: 303854 - DNA, 20 bp, Artificial Sequence
  Description of Artificial Sequence: Synthetic oligonucleotide
  Target: ATXN1; (+) strand; PAM type: YTN; PAM sequence: CTA
cctggagggtctgtggggat

SEQ ID NO: 303855 - DNA, 20 bp, Artificial Sequence
  Description of Artificial Sequence: Synthetic oligonucleotide
  Target: ATXN1; (+) strand; PAM type: YTN; PAM sequence: CTG
gagggtctgtggggataacc

SEQ ID NO: 303856 - DNA, 20 bp, Artificial Sequence
  Description of Artificial Sequence: Synthetic oligonucleotide
  Target: ATXN1; (+) strand; PAM type: YTN; PAM sequence: CTG
tggggataacccctattccg

SEQ ID NO: 303857 - DNA, 20 bp, Artificial Sequence
  Description of Artificial Sequence: Synthetic oligonucleotide
  Target: ATXN1; (+) strand; PAM type: YTN; PAM sequence: CTA
ttccgtacaaaggaacagtg

SEQ ID NO: 303858 - DNA, 20 bp, Artificial Sequence
  Description of Artificial Sequence: Synthetic oligonucleotide
  Target: ATXN1; (+) strand; PAM type: YTN; PAM sequence: TTC
cgtacaaaggaacagtgaac

SEQ ID NO: 303859 - DNA, 20 bp, Artificial Sequence
  Description of Artificial Sequence: Synthetic oligonucleotide
  Target: ATXN1; (+) strand; PAM type: YTN; PAM sequence: CTT
gagtgaaaacagccacgcaa

SEQ ID NO: 303860 - DNA, 20 bp, Artificial Sequence
  Description of Artificial Sequence: Synthetic oligonucleotide
  Target: ATXN1; (+) strand; PAM type: YTN; PAM sequence: TTG
agtgaaaacagccacgcaag

SEQ ID NO: 303861 - DNA, 20 bp, Artificial Sequence
  Description of Artificial Sequence: Synthetic oligonucleotide
  Target: ATXN1; (+) strand; PAM type: YTN; PAM sequence: CTA
aggcaggggaagaacggtgg

SEQ ID NO: 303862 - DNA, 20 bp, Artificial Sequence
  Description of Artificial Sequence: Synthetic oligonucleotide
  Target: ATXN1; (+) strand; PAM type: YTN; PAM sequence: CTG
ctacagtgagaagagaaata

SEQ ID NO: 303863 - DNA, 20 bp, Artificial Sequence
  Description of Artificial Sequence: Synthetic oligonucleotide
  Target: ATXN1; (+) strand; PAM type: YTN; PAM sequence: CTA
cagtgagaagagaaatagag

SEQ ID NO: 303864 - DNA, 20 bp, Artificial Sequence
  Description of Artificial Sequence: Synthetic oligonucleotide
  Target: ATXN1; (+) strand; PAM type: YTN; PAM sequence: CTG
agtcagaaggggaaggtata

SEQ ID NO: 303865 - DNA, 20 bp, Artificial Sequence
  Description of Artificial Sequence: Synthetic oligonucleotide
  Target: ATXN1; (+) strand; PAM type: YTN; PAM sequence: CTG
aacgcaagaagtagaaagta

SEQ ID NO: 303866 - DNA, 20 bp, Artificial Sequence
  Description of Artificial Sequence: Synthetic oligonucleotide
  Target: ATXN1; (+) strand; PAM type: YTN; PAM sequence: CTA
aattcgtgtttccaaataat

SEQ ID NO: 303867 - DNA, 20 bp, Artificial Sequence
  Description of Artificial Sequence: Synthetic oligonucleotide
  Target: ATXN1; (+) strand; PAM type: YTN; PAM sequence: TTC
gtgtttccaaataatccagt

SEQ ID NO: 303868 - DNA, 20 bp, Artificial Sequence
  Description of Artificial Sequence: Synthetic oligonucleotide
  Target: ATXN1; (+) strand; PAM type: YTN; PAM sequence: TTT
ccaaataatccagttaccac

SEQ ID NO: 303869 - DNA, 20 bp, Artificial Sequence
  Description of Artificial Sequence: Synthetic oligonucleotide
  Target: ATXN1; (+) strand; PAM type: YTN; PAM sequence: TTC
caaataatccagttaccaca

SEQ ID NO: 303870 - DNA, 20 bp, Artificial Sequence
  Description of Artificial Sequence: Synthetic oligonucleotide
  Target: ATXN1; (+) strand; PAM type: YTN; PAM sequence: TTA
ccacattacactcaaaaaaa

SEQ ID NO: 303871 - DNA, 20 bp, Artificial Sequence
  Description of Artificial Sequence: Synthetic oligonucleotide
  Target: ATXN1; (+) strand; PAM type: YTN; PAM sequence: TTA
cactcaaaaaaagaaccaaa

SEQ ID NO: 303872 - DNA, 20 bp, Artificial Sequence
  Description of Artificial Sequence: Synthetic oligonucleotide
  Target: ATXN1; (+) strand; PAM type: YTN; PAM sequence: CTC
aaaaaaagaaccaaaggcag

SEQ ID NO: 303873 - DNA, 20 bp, Artificial Sequence
  Description of Artificial Sequence: Synthetic oligonucleotide
  Target: ATXN1; (+) strand; PAM type: YTN; PAM sequence: TTT
tatttggaaattgttctctt

SEQ ID NO: 303874 - DNA, 20 bp, Artificial Sequence
  Description of Artificial Sequence: Synthetic oligonucleotide
  Target: ATXN1; (+) strand; PAM type: YTN; PAM sequence: TTT
atttggaaattgttctcttc

SEQ ID NO: 303875 - DNA, 20 bp, Artificial Sequence
  Description of Artificial Sequence: Synthetic oligonucleotide
  Target: ATXN1; (+) strand; PAM type: YTN; PAM sequence: TTA
tttggaaattgttctcttcc

SEQ ID NO: 303876 - DNA, 20 bp, Artificial Sequence
  Description of Artificial Sequence: Synthetic oligonucleotide
  Target: ATXN1; (+) strand; PAM type: YTN; PAM sequence: TTT
ggaaattgttctcttcctcc

SEQ ID NO: 303877 - DNA, 20 bp, Artificial Sequence
  Description of Artificial Sequence: Synthetic oligonucleotide
  Target: ATXN1; (+) strand; PAM type: YTN; PAM sequence: TTG
gaaattgttctcttcctccc

SEQ ID NO: 303878 - DNA, 20 bp, Artificial Sequence
  Description of Artificial Sequence: Synthetic oligonucleotide
  Target: ATXN1; (+) strand; PAM type: YTN; PAM sequence: TTG
ttctcttcctccctcgacac

SEQ ID NO: 303879 - DNA, 20 bp, Artificial Sequence
  Description of Artificial Sequence: Synthetic oligonucleotide
  Target: ATXN1; (+) strand; PAM type: YTN; PAM sequence: TTC
tcttcctccctcgacacctc

SEQ ID NO: 303880 - DNA, 20 bp, Artificial Sequence
  Description of Artificial Sequence: Synthetic oligonucleotide
  Target: ATXN1; (+) strand; PAM type: YTN; PAM sequence: CTC
ttcctccctcgacacctctg

SEQ ID NO: 303881 - DNA, 20 bp, Artificial Sequence
  Description of Artificial Sequence: Synthetic oligonucleotide
  Target: ATXN1; (+) strand; PAM type: YTN; PAM sequence: CTT
cctccctcgacacctctgtt

SEQ ID NO: 303882 - DNA, 20 bp, Artificial Sequence
  Description of Artificial Sequence: Synthetic oligonucleotide
  Target: ATXN1; (+) strand; PAM type: YTN; PAM sequence: TTC
ctccctcgacacctctgtta

SEQ ID NO: 303883 - DNA, 20 bp, Artificial Sequence
  Description of Artificial Sequence: Synthetic oligonucleotide
  Target: ATXN1; (+) strand; PAM type: YTN; PAM sequence: CTC
cctcgacacctctgttaatc

SEQ ID NO: 303884 - DNA, 20 bp, Artificial Sequence
  Description of Artificial Sequence: Synthetic oligonucleotide
  Target: ATXN1; (+) strand; PAM type: YTN; PAM sequence: CTC
gacacctctgttaatcaaat

SEQ ID NO: 303885 - DNA, 20 bp, Artificial Sequence
  Description of Artificial Sequence: Synthetic oligonucleotide
  Target: ATXN1; (+) strand; PAM type: YTN; PAM sequence: CTC
tgttaatcaaattggaagct

SEQ ID NO: 303886 - DNA, 20 bp, Artificial Sequence
  Description of Artificial Sequence: Synthetic oligonucleotide
  Target: ATXN1; (+) strand; PAM type: YTN; PAM sequence: CTG
ttaatcaaattggaagctag

SEQ ID NO: 303887 - DNA, 20 bp, Artificial Sequence
  Description of Artificial Sequence: Synthetic oligonucleotide
  Target: ATXN1; (+) strand; PAM type: YTN; PAM sequence: TTA
atcaaattggaagctagggg

SEQ ID NO: 303888 - DNA, 20 bp, Artificial Sequence
  Description of Artificial Sequence: Synthetic oligonucleotide
  Target: ATXN1; (+) strand; PAM type: YTN; PAM sequence: TTG
gaagctaggggagggaactg

SEQ ID NO: 303889 - DNA, 20 bp, Artificial Sequence
  Description of Artificial Sequence: Synthetic oligonucleotide
  Target: ATXN1; (+) strand; PAM type: YTN; PAM sequence: CTA
ggggagggaactgagtaaag

SEQ ID NO: 303890 - DNA, 20 bp, Artificial Sequence
  Description of Artificial Sequence: Synthetic oligonucleotide
  Target: ATXN1; (+) strand; PAM type: YTN; PAM sequence: CTG
agtaaaggcagggacctgaa

SEQ ID NO: 303891 - DNA, 20 bp, Artificial Sequence
  Description of Artificial Sequence: Synthetic oligonucleotide
  Target: ATXN1; (+) strand; PAM type: YTN; PAM sequence: CTG
aacatatccctccgtttttg

SEQ ID NO: 303892 - DNA, 20 bp, Artificial Sequence
  Description of Artificial Sequence: Synthetic oligonucleotide
  Target: ATXN1; (+) strand; PAM type: YTN; PAM sequence: CTC
cgtttttgcttttttttttt

SEQ ID NO: 303893 - DNA, 20 bp, Artificial Sequence
  Description of Artificial Sequence: Synthetic oligonucleotide
  Target: ATXN1; (+) strand; PAM type: YTN; PAM sequence: TTT
ttgctttttttttttttctt

SEQ ID NO: 303894 - DNA, 20 bp, Artificial Sequence
  Description of Artificial Sequence: Synthetic oligonucleotide
  Target: ATXN1; (+) strand; PAM type: YTN; PAM sequence: TTT
tgctttttttttttttcttt

SEQ ID NO: 303895 - DNA, 20 bp, Artificial Sequence
  Description of Artificial Sequence: Synthetic oligonucleotide
  Target: ATXN1; (+) strand; PAM type: YTN; PAM sequence: TTT
gctttttttttttttctttt

SEQ ID NO: 303896 - DNA, 20 bp, Artificial Sequence
  Description of Artificial Sequence: Synthetic oligonucleotide
  Target: ATXN1; (+) strand; PAM type: YTN; PAM sequence: TTG
ctttttttttttttcttttg

SEQ ID NO: 303897 - DNA, 20 bp, Artificial Sequence
  Description of Artificial Sequence: Synthetic oligonucleotide
  Target: ATXN1; (+) strand; PAM type: YTN; PAM sequence: CTT
tttttttttttcttttgccc

SEQ ID NO: 303898 - DNA, 20 bp, Artificial Sequence
  Description of Artificial Sequence: Synthetic oligonucleotide
  Target: ATXN1; (+) strand; PAM type: YTN; PAM sequence: TTT
ttttttttttcttttgcccc

SEQ ID NO: 303899 - DNA, 20 bp, Artificial Sequence
  Description of Artificial Sequence: Synthetic oligonucleotide
  Target: ATXN1; (+) strand; PAM type: YTN; PAM sequence: TTT
tttttttttcttttgcccct

SEQ ID NO: 303900 - DNA, 20 bp, Artificial Sequence
  Description of Artificial Sequence: Synthetic oligonucleotide
  Target: ATXN1; (+) strand; PAM type: YTN; PAM sequence: TTT
ttttttttcttttgcccctt

SEQ ID NO: 303901 - DNA, 20 bp, Artificial Sequence
  Description of Artificial Sequence: Synthetic oligonucleotide
  Target: ATXN1; (+) strand; PAM type: YTN; PAM sequence: TTT
tttttttcttttgcccctta

SEQ ID NO: 303902 - DNA, 20 bp, Artificial Sequence
  Description of Artificial Sequence: Synthetic oligonucleotide
  Target: ATXN1; (+) strand; PAM type: YTN; PAM sequence: TTT
ttttttcttttgccccttaa

SEQ ID NO: 303903 - DNA, 20 bp, Artificial Sequence
  Description of Artificial Sequence: Synthetic oligonucleotide
  Target: ATXN1; (+) strand; PAM type: YTN; PAM sequence: TTT
tttttcttttgccccttaat

SEQ ID NO: 303904 - DNA, 20 bp, Artificial Sequence
  Description of Artificial Sequence: Synthetic oligonucleotide
  Target: ATXN1; (+) strand; PAM type: YTN; PAM sequence: TTT
ttttcttttgccccttaatc

SEQ ID NO: 303905 - DNA, 20 bp, Artificial Sequence
  Description of Artificial Sequence: Synthetic oligonucleotide
  Target: ATXN1; (+) strand; PAM type: YTN; PAM sequence: TTT
tttcttttgccccttaatca

SEQ ID NO: 303906 - DNA, 20 bp, Artificial Sequence
  Description of Artificial Sequence: Synthetic oligonucleotide
  Target: ATXN1; (+) strand; PAM type: YTN; PAM sequence: TTT
ttcttttgccccttaatcag

SEQ ID NO: 303907 - DNA, 20 bp, Artificial Sequence
  Description of Artificial Sequence: Synthetic oligonucleotide
  Target: ATXN1; (+) strand; PAM type: YTN; PAM sequence: TTT
tcttttgccccttaatcagc

SEQ ID NO: 303908 - DNA, 20 bp, Artificial Sequence
  Description of Artificial Sequence: Synthetic oligonucleotide
  Target: ATXN1; (+) strand; PAM type: YTN; PAM sequence: TTT
cttttgccccttaatcagcc

SEQ ID NO: 303909 - DNA, 20 bp, Artificial Sequence
  Description of Artificial Sequence: Synthetic oligonucleotide
  Target: ATXN1; (+) strand; PAM type: YTN; PAM sequence: TTC
ttttgccccttaatcagcca

SEQ ID NO: 303910 - DNA, 20 bp, Artificial Sequence
  Description of Artificial Sequence: Synthetic oligonucleotide
  Target: ATXN1; (+) strand; PAM type: YTN; PAM sequence: CTT
ttgccccttaatcagccacc

SEQ ID NO: 303911 - DNA, 20 bp, Artificial Sequence
  Description of Artificial Sequence: Synthetic oligonucleotide
  Target: ATXN1; (+) strand; PAM type: YTN; PAM sequence: TTT
tgccccttaatcagccacct

SEQ ID NO: 303912 - DNA, 20 bp, Artificial Sequence
  Description of Artificial Sequence: Synthetic oligonucleotide
  Target: ATXN1; (+) strand; PAM type: YTN; PAM sequence: TTT
gccccttaatcagccacctt

SEQ ID NO: 303913 - DNA, 20 bp, Artificial Sequence
  Description of Artificial Sequence: Synthetic oligonucleotide
  Target: ATXN1; (+) strand; PAM type: YTN; PAM sequence: TTG
ccccttaatcagccaccttc

SEQ ID NO: 303914 - DNA, 20 bp, Artificial Sequence
  Description of Artificial Sequence: Synthetic oligonucleotide
  Target: ATXN1; (+) strand; PAM type: YTN; PAM sequence: CTT
aatcagccaccttcaaaaca

SEQ ID NO: 303915 - DNA, 20 bp, Artificial Sequence
  Description of Artificial Sequence: Synthetic oligonucleotide
  Target: ATXN1; (+) strand; PAM type: YTN; PAM sequence: TTA
atcagccaccttcaaaacag

SEQ ID NO: 303916 - DNA, 20 bp, Artificial Sequence
  Description of Artificial Sequence: Synthetic oligonucleotide
  Target: ATXN1; (+) strand; PAM type: YTN; PAM sequence: CTT
caaaacagtgcctttctagg

SEQ ID NO: 303917 - DNA, 20 bp, Artificial Sequence
  Description of Artificial Sequence: Synthetic oligonucleotide
  Target: ATXN1; (+) strand; PAM type: YTN; PAM sequence: TTC
aaaacagtgcctttctaggg

SEQ ID NO: 303918 - DNA, 20 bp, Artificial Sequence
  Description of Artificial Sequence: Synthetic oligonucleotide
  Target: ATXN1; (+) strand; PAM type: YTN; PAM sequence: CTT
tctagggctaacgtcctgcc

SEQ ID NO: 303919 - DNA, 20 bp, Artificial Sequence
  Description of Artificial Sequence: Synthetic oligonucleotide
  Target: ATXN1; (+) strand; PAM type: YTN; PAM sequence: TTT
ctagggctaacgtcctgcct

SEQ ID NO: 303920 - DNA, 20 bp, Artificial Sequence
  Description of Artificial Sequence: Synthetic oligonucleotide
  Target: ATXN1; (+) strand; PAM type: YTN; PAM sequence: TTC
tagggctaacgtcctgcctg

SEQ ID NO: 303921 - DNA, 20 bp, Artificial Sequence
  Description of Artificial Sequence: Synthetic oligonucleotide
  Target: ATXN1; (+) strand; PAM type: YTN; PAM sequence: CTA
gggctaacgtcctgcctgtg

SEQ ID NO: 303922 - DNA, 20 bp, Artificial Sequence
  Description of Artificial Sequence: Synthetic oligonucleotide
  Target: ATXN1; (+) strand; PAM type: YTN; PAM sequence: CTA
acgtcctgcctgtggcatct

SEQ ID NO: 303923 - DNA, 20 bp, Artificial Sequence
  Description of Artificial Sequence: Synthetic oligonucleotide
  Target: ATXN1; (+) strand; PAM type: YTN; PAM sequence: CTG
cctgtggcatctcatcactg

SEQ ID NO: 303924 - DNA, 20 bp, Artificial Sequence
  Description of Artificial Sequence: Synthetic oligonucleotide
  Target: ATXN1; (+) strand; PAM type: YTN; PAM sequence: CTG
tggcatctcatcactgataa

SEQ ID NO: 303925 - DNA, 20 bp, Artificial Sequence
  Description of Artificial Sequence: Synthetic oligonucleotide
  Target: ATXN1; (+) strand; PAM type: YTN; PAM sequence: CTC
atcactgataaacatcagga

SEQ ID NO: 303926 - DNA, 20 bp, Artificial Sequence
  Description of Artificial Sequence: Synthetic oligonucleotide
  Target: ATXN1; (+) strand; PAM type: YTN; PAM sequence: CTG
ataaacatcaggaagtaact

SEQ ID NO: 303927 - DNA, 20 bp, Artificial Sequence
  Description of Artificial Sequence: Synthetic oligonucleotide
  Target: ATXN1; (+) strand; PAM type: YTN; PAM sequence: CTG
ccattcgccatttatagatt

SEQ ID NO: 303928 - DNA, 20 bp, Artificial Sequence
  Description of Artificial Sequence: Synthetic oligonucleotide
  Target: ATXN1; (+) strand; PAM type: YTN; PAM sequence: TTC
gccatttatagatttatatg

SEQ ID NO: 303929 - DNA, 20 bp, Artificial Sequence
  Description of Artificial Sequence: Synthetic oligonucleotide
  Target: ATXN1; (+) strand; PAM type: YTN; PAM sequence: TTT
atagatttatatgtacctgc

SEQ ID NO: 303930 - DNA, 20 bp, Artificial Sequence
  Description of Artificial Sequence: Synthetic oligonucleotide
  Target: ATXN1; (+) strand; PAM type: YTN; PAM sequence: TTA
tagatttatatgtacctgct

SEQ ID NO: 303931 - DNA, 20 bp, Artificial Sequence
  Description of Artificial Sequence: Synthetic oligonucleotide
  Target: ATXN1; (+) strand; PAM type: YTN; PAM sequence: TTT
atatgtacctgctaggataa

SEQ ID NO: 303932 - DNA, 20 bp, Artificial Sequence
  Description of Artificial Sequence: Synthetic oligonucleotide
  Target: ATXN1; (+) strand; PAM type: YTN; PAM sequence: TTA
tatgtacctgctaggataat

SEQ ID NO: 303933 - DNA, 20 bp, Artificial Sequence
  Description of Artificial Sequence: Synthetic oligonucleotide
  Target: ATXN1; (+) strand; PAM type: YTN; PAM sequence: CTG
ctaggataatgagattcaca

SEQ ID NO: 303934 - DNA, 20 bp, Artificial Sequence
  Description of Artificial Sequence: Synthetic oligonucleotide
  Target: ATXN1; (+) strand; PAM type: YTN; PAM sequence: CTA
ggataatgagattcacaatc

SEQ ID NO: 303935 - DNA, 20 bp, Artificial Sequence
  Description of Artificial Sequence: Synthetic oligonucleotide
  Target: ATXN1; (+) strand; PAM type: YTN; PAM sequence: TTC
acaatctgttcattccctta

SEQ ID NO: 303936 - DNA, 20 bp, Artificial Sequence
  Description of Artificial Sequence: Synthetic oligonucleotide
  Target: ATXN1; (+) strand; PAM type: YTN; PAM sequence: CTG
ttcattcccttagtaactga

SEQ ID NO: 303937 - DNA, 20 bp, Artificial Sequence
  Description of Artificial Sequence: Synthetic oligonucleotide
  Target: ATXN1; (+) strand; PAM type: YTN; PAM sequence: TTC
attcccttagtaactgaatg

SEQ ID NO: 303938 - DNA, 20 bp, Artificial Sequence
  Description of Artificial Sequence: Synthetic oligonucleotide
  Target: ATXN1; (+) strand; PAM type: YTN; PAM sequence: TTC
ccttagtaactgaatgaaac

SEQ ID NO: 303939 - DNA, 20 bp, Artificial Sequence
  Description of Artificial Sequence: Synthetic oligonucleotide
  Target: ATXN1; (+) strand; PAM type: YTN; PAM sequence: CTT
agtaactgaatgaaactcac

SEQ ID NO: 303940 - DNA, 20 bp, Artificial Sequence
  Description of Artificial Sequence: Synthetic oligonucleotide
  Target: ATXN1; (+) strand; PAM type: YTN; PAM sequence: TTA
gtaactgaatgaaactcaca

SEQ ID NO: 303941 - DNA, 20 bp, Artificial Sequence
  Description of Artificial Sequence: Synthetic oligonucleotide
  Target: ATXN1; (+) strand; PAM type: YTN; PAM sequence: CTG
aatgaaactcacaaatggct

SEQ ID NO: 303942 - DNA, 20 bp, Artificial Sequence
  Description of Artificial Sequence: Synthetic oligonucleotide
  Target: ATXN1; (+) strand; PAM type: YTN; PAM sequence: CTC
acaaatggctacgagggagt

SEQ ID NO: 303943 - DNA, 20 bp, Artificial Sequence
  Description of Artificial Sequence: Synthetic oligonucleotide
  Target: ATXN1; (+) strand; PAM type: YTN; PAM sequence: CTA
cgagggagtatcctagttca

SEQ ID NO: 303944 - DNA, 20 bp, Artificial Sequence
  Description of Artificial Sequence: Synthetic oligonucleotide
  Target: ATXN1; (+) strand; PAM type: YTN; PAM sequence: CTA
gttcactgaagcccaagctg

SEQ ID NO: 303945 - DNA, 20 bp, Artificial Sequence
  Description of Artificial Sequence: Synthetic oligonucleotide
  Target: ATXN1; (+) strand; PAM type: YTN; PAM sequence: TTC
actgaagcccaagctggcct

SEQ ID NO: 303946 - DNA, 20 bp, Artificial Sequence
  Description of Artificial Sequence: Synthetic oligonucleotide
  Target: ATXN1; (+) strand; PAM type: YTN; PAM sequence: CTG
aagcccaagctggcctcagg

SEQ ID NO: 303947 - DNA, 20 bp, Artificial Sequence
  Description of Artificial Sequence: Synthetic oligonucleotide
  Target: ATXN1; (+) strand; PAM type: YTN; PAM sequence: CTG
gcctcaggaaccagagataa

SEQ ID NO: 303948 - DNA, 20 bp, Artificial Sequence
  Description of Artificial Sequence: Synthetic oligonucleotide
  Target: ATXN1; (+) strand; PAM type: YTN; PAM sequence: CTC
aggaaccagagataacattt

SEQ ID NO: 303949 - DNA, 20 bp, Artificial Sequence
  Description of Artificial Sequence: Synthetic oligonucleotide
  Target: ATXN1; (+) strand; PAM type: YTN; PAM sequence: TTT
ctcctttttccagctgaatt

SEQ ID NO: 303950 - DNA, 20 bp, Artificial Sequence
  Description of Artificial Sequence: Synthetic oligonucleotide
  Target: ATXN1; (+) strand; PAM type: YTN; PAM sequence: TTC
tcctttttccagctgaatta

SEQ ID NO: 303951 - DNA, 20 bp, Artificial Sequence
  Description of Artificial Sequence: Synthetic oligonucleotide
  Target: ATXN1; (+) strand; PAM type: YTN; PAM sequence: CTC
ctttttccagctgaattact

SEQ ID NO: 303952 - DNA, 20 bp, Artificial Sequence
  Description of Artificial Sequence: Synthetic oligonucleotide
  Target: ATXN1; (+) strand; PAM type: YTN; PAM sequence: CTT
tttccagctgaattactaag

SEQ ID NO: 303953 - DNA, 20 bp, Artificial Sequence
  Description of Artificial Sequence: Synthetic oligonucleotide
  Target: ATXN1; (+) strand; PAM type: YTN; PAM sequence: TTT
ttccagctgaattactaaga

SEQ ID NO: 303954 - DNA, 20 bp, Artificial Sequence
  Description of Artificial Sequence: Synthetic oligonucleotide
  Target: ATXN1; (+) strand; PAM type: YTN; PAM sequence: TTT
tccagctgaattactaagac

SEQ ID NO: 303955 - DNA, 20 bp, Artificial Sequence
  Description of Artificial Sequence: Synthetic oligonucleotide
  Target: ATXN1; (+) strand; PAM type: YTN; PAM sequence: TTT
ccagctgaattactaagaca

SEQ ID NO: 303956 - DNA, 20 bp, Artificial Sequence
  Description of Artificial Sequence: Synthetic oligonucleotide
  Target: ATXN1; (+) strand; PAM type: YTN; PAM sequence: TTC
cagctgaattactaagacaa

SEQ ID NO: 303957 - DNA, 20 bp, Artificial Sequence
  Description of Artificial Sequence: Synthetic oligonucleotide
  Target: ATXN1; (+) strand; PAM type: YTN; PAM sequence: CTG
aattactaagacaagcaaga

SEQ ID NO: 303958 - DNA, 20 bp, Artificial Sequence
  Description of Artificial Sequence: Synthetic oligonucleotide
  Target: ATXN1; (+) strand; PAM type: YTN; PAM sequence: TTA
ctaagacaagcaagagatga

SEQ ID NO: 303959 - DNA, 20 bp, Artificial Sequence
  Description of Artificial Sequence: Synthetic oligonucleotide
  Target: ATXN1; (+) strand; PAM type: YTN; PAM sequence: CTA
agacaagcaagagatgactc

SEQ ID NO: 303960 - DNA, 20 bp, Artificial Sequence
  Description of Artificial Sequence: Synthetic oligonucleotide
  Target: ATXN1; (+) strand; PAM type: YTN; PAM sequence: CTC
ataataagcatagttgatga

SEQ ID NO: 303961 - DNA, 20 bp, Artificial Sequence
  Description of Artificial Sequence: Synthetic oligonucleotide
  Target: ATXN1; (+) strand; PAM type: YTN; PAM sequence: TTG
atgaagcaattaatgccaac

SEQ ID NO: 303962 - DNA, 20 bp, Artificial Sequence
  Description of Artificial Sequence: Synthetic oligonucleotide
  Target: ATXN1; (+) strand; PAM type: YTN; PAM sequence: TTA
atgccaactcttcctctctg

SEQ ID NO: 303963 - DNA, 20 bp, Artificial Sequence
  Description of Artificial Sequence: Synthetic oligonucleotide
  Target: ATXN1; (+) strand; PAM type: YTN; PAM sequence: CTC
ttcctctctgagtcatccct

SEQ ID NO: 303964 - DNA, 20 bp, Artificial Sequence
  Description of Artificial Sequence: Synthetic oligonucleotide
  Target: ATXN1; (+) strand; PAM type: YTN; PAM sequence: CTT
cctctctgagtcatcccttc

SEQ ID NO: 303965 - DNA, 20 bp, Artificial Sequence
  Description of Artificial Sequence: Synthetic oligonucleotide
  Target: ATXN1; (+) strand; PAM type: YTN; PAM sequence: TTC
ctctctgagtcatcccttcc

SEQ ID NO: 303966 - DNA, 20 bp, Artificial Sequence
  Description of Artificial Sequence: Synthetic oligonucleotide
  Target: ATXN1; (+) strand; PAM type: YTN; PAM sequence: CTC
tctgagtcatcccttccagt

SEQ ID NO: 303967 - DNA, 20 bp, Artificial Sequence
  Description of Artificial Sequence: Synthetic oligonucleotide
  Target: ATXN1; (+) strand; PAM type: YTN; PAM sequence: CTC
tgagtcatcccttccagtga

SEQ ID NO: 303968 - DNA, 20 bp, Artificial Sequence
  Description of Artificial Sequence: Synthetic oligonucleotide
  Target: ATXN1; (+) strand; PAM type: YTN; PAM sequence: CTG
agtcatcccttccagtgaaa

SEQ ID NO: 303969 - DNA, 20 bp, Artificial Sequence
  Description of Artificial Sequence: Synthetic oligonucleotide
  Target: ATXN1; (+) strand; PAM type: YTN; PAM sequence: CTT
ccagtgaaagaatcgctagg

SEQ ID NO: 303970 - DNA, 20 bp, Artificial Sequence
  Description of Artificial Sequence: Synthetic oligonucleotide
  Target: ATXN1; (+) strand; PAM type: YTN; PAM sequence: TTC
cagtgaaagaatcgctagga

SEQ ID NO: 303971 - DNA, 20 bp, Artificial Sequence
  Description of Artificial Sequence: Synthetic oligonucleotide
  Target: ATXN1; (+) strand; PAM type: YTN; PAM sequence: CTA
ggagtattaaccctggctga

SEQ ID NO: 303972 - DNA, 20 bp, Artificial Sequence
  Description of Artificial Sequence: Synthetic oligonucleotide
  Target: ATXN1; (+) strand; PAM type: YTN; PAM sequence: TTA
accctggctgaaaaagtaga

SEQ ID NO: 303973 - DNA, 20 bp, Artificial Sequence
  Description of Artificial Sequence: Synthetic oligonucleotide
  Target: ATXN1; (+) strand; PAM type: YTN; PAM sequence: CTG
gctgaaaaagtagatgccat

SEQ ID NO: 303974 - DNA, 20 bp, Artificial Sequence
  Description of Artificial Sequence: Synthetic oligonucleotide
  Target: ATXN1; (+) strand; PAM type: YTN; PAM sequence: CTG
aaaaagtagatgccatgtga

SEQ ID NO: 303975 - DNA, 20 bp, Artificial Sequence
  Description of Artificial Sequence: Synthetic oligonucleotide
  Target: ATXN1; (+) strand; PAM type: YTN; PAM sequence: TTA
aactttaccaaacaatggag

SEQ ID NO: 303976 - DNA, 20 bp, Artificial Sequence
  Description of Artificial Sequence: Synthetic oligonucleotide
  Target: ATXN1; (+) strand; PAM type: YTN; PAM sequence: CTT
taccaaacaatggagtggta

SEQ ID NO: 303977 - DNA, 20 bp, Artificial Sequence
  Description of Artificial Sequence: Synthetic oligonucleotide
  Target: ATXN1; (+) strand; PAM type: YTN; PAM sequence: TTT
accaaacaatggagtggtaa

SEQ ID NO: 303978 - DNA, 20 bp, Artificial Sequence
  Description of Artificial Sequence: Synthetic oligonucleotide
  Target: ATXN1; (+) strand; PAM type: YTN; PAM sequence: TTA
ccaaacaatggagtggtaag

SEQ ID NO: 303979 - DNA, 20 bp, Artificial Sequence
  Description of Artificial Sequence: Synthetic oligonucleotide
  Target: ATXN1; (+) strand; PAM type: YTN; PAM sequence: TTG
gagggtttctgtccaaacta

SEQ ID NO: 303980 - DNA, 20 bp, Artificial Sequence
  Description of Artificial Sequence: Synthetic oligonucleotide
  Target: ATXN1; (+) strand; PAM type: YTN; PAM sequence: TTT
ctgtccaaactatctgaatc

SEQ ID NO: 303981 - DNA, 20 bp, Artificial Sequence
  Description of Artificial Sequence: Synthetic oligonucleotide
  Target: ATXN1; (+) strand; PAM type: YTN; PAM sequence: TTC
tgtccaaactatctgaatct

SEQ ID NO: 303982 - DNA, 20 bp, Artificial Sequence
  Description of Artificial Sequence: Synthetic oligonucleotide
  Target: ATXN1; (+) strand; PAM type: YTN; PAM sequence: CTG
tccaaactatctgaatctag

SEQ ID NO: 303983 - DNA, 20 bp, Artificial Sequence
  Description of Artificial Sequence: Synthetic oligonucleotide
  Target: ATXN1; (+) strand; PAM type: YTN; PAM sequence: CTA
tctgaatctagagggaccgc

SEQ ID NO: 303984 - DNA, 20 bp, Artificial Sequence
  Description of Artificial Sequence: Synthetic oligonucleotide
  Target: ATXN1; (+) strand; PAM type: YTN; PAM sequence: CTG
aatctagagggaccgctcca

SEQ ID NO: 303985 - DNA, 20 bp, Artificial Sequence
  Description of Artificial Sequence: Synthetic oligonucleotide
  Target: ATXN1; (+) strand; PAM type: YTN; PAM sequence: CTA
gagggaccgctccatgaata

SEQ ID NO: 303986 - DNA, 20 bp, Artificial Sequence
  Description of Artificial Sequence: Synthetic oligonucleotide
  Target: ATXN1; (+) strand; PAM type: YTN; PAM sequence: CTC
catgaataagtttcaataca

SEQ ID NO: 303987 - DNA, 20 bp, Artificial Sequence
  Description of Artificial Sequence: Synthetic oligonucleotide
  Target: ATXN1; (+) strand; PAM type: YTN; PAM sequence: TTT
caatacaattgcggtaatca

SEQ ID NO: 303988 - DNA, 20 bp, Artificial Sequence
  Description of Artificial Sequence: Synthetic oligonucleotide
  Target: ATXN1; (+) strand; PAM type: YTN; PAM sequence: TTC
aatacaattgcggtaatcag

SEQ ID NO: 303989 - DNA, 20 bp, Artificial Sequence
  Description of Artificial Sequence: Synthetic oligonucleotide
  Target: ATXN1; (+) strand; PAM type: YTN; PAM sequence: TTG
cggtaatcagcaccgcttcc

SEQ ID NO: 303990 - DNA, 20 bp, Artificial Sequence
  Description of Artificial Sequence: Synthetic oligonucleotide
  Target: ATXN1; (+) strand; PAM type: YTN; PAM sequence: CTT
cctctatttcaatttacaaa

SEQ ID NO: 303991 - DNA, 20 bp, Artificial Sequence
  Description of Artificial Sequence: Synthetic oligonucleotide
  Target: ATXN1; (+) strand; PAM type: YTN; PAM sequence: TTC
ctctatttcaatttacaaac

SEQ ID NO: 303992 - DNA, 20 bp, Artificial Sequence
  Description of Artificial Sequence: Synthetic oligonucleotide
  Target: ATXN1; (+) strand; PAM type: YTN; PAM sequence: CTC
tatttcaatttacaaacgct

SEQ ID NO: 303993 - DNA, 20 bp, Artificial Sequence
  Description of Artificial Sequence: Synthetic oligonucleotide
  Target: ATXN1; (+) strand; PAM type: YTN; PAM sequence: CTA
tttcaatttacaaacgctgg

SEQ ID NO: 303994 - DNA, 20 bp, Artificial Sequence
  Description of Artificial Sequence: Synthetic oligonucleotide
  Target: ATXN1; (+) strand; PAM type: YTN; PAM sequence: TTT
caatttacaaacgctgggtt

SEQ ID NO: 303995 - DNA, 20 bp, Artificial Sequence
  Description of Artificial Sequence: Synthetic oligonucleotide
  Target: ATXN1; (+) strand; PAM type: YTN; PAM sequence: TTC
aatttacaaacgctgggttt

SEQ ID NO: 303996 - DNA, 20 bp, Artificial Sequence
  Description of Artificial Sequence: Synthetic oligonucleotide
  Target: ATXN1; (+) strand; PAM type: YTN; PAM sequence: TTT
acaaacgctgggtttacagg

SEQ ID NO: 303997 - DNA, 20 bp, Artificial Sequence
  Description of Artificial Sequence: Synthetic oligonucleotide
  Target: ATXN1; (+) strand; PAM type: YTN; PAM sequence: TTA
caaacgctgggtttacagga

SEQ ID NO: 303998 - DNA, 20 bp, Artificial Sequence
  Description of Artificial Sequence: Synthetic oligonucleotide
  Target: ATXN1; (+) strand; PAM type: YTN; PAM sequence: CTG
ggtttacaggaatagctttc

SEQ ID NO: 303999 - DNA, 20 bp, Artificial Sequence
  Description of Artificial Sequence: Synthetic oligonucleotide
  Target: ATXN1; (+) strand; PAM type: YTN; PAM sequence: TTT
acaggaatagctttctgaga

SEQ ID NO: 304000 - DNA, 20 bp, Artificial Sequence
  Description of Artificial Sequence: Synthetic oligonucleotide
  Target: ATXN1; (+) strand; PAM type: YTN; PAM sequence: TTA
caggaatagctttctgagac

SEQ ID NO: 304001 - DNA, 20 bp, Artificial Sequence
  Description of Artificial Sequence: Synthetic oligonucleotide
  Target: ATXN1; (+) strand; PAM type: YTN; PAM sequence: CTT
tctgagacattcctataaaa

SEQ ID NO: 304002 - DNA, 20 bp, Artificial Sequence
  Description of Artificial Sequence: Synthetic oligonucleotide
  Target: ATXN1; (+) strand; PAM type: YTN; PAM sequence: TTT
ctgagacattcctataaaat

SEQ ID NO: 304003 - DNA, 20 bp, Artificial Sequence
  Description of Artificial Sequence: Synthetic oligonucleotide
  Target: ATXN1; (+) strand; PAM type: YTN; PAM sequence: TTC
tgagacattcctataaaatt

SEQ ID NO: 304004 - DNA, 20 bp, Artificial Sequence
  Description of Artificial Sequence: Synthetic oligonucleotide
  Target: ATXN1; (+) strand; PAM type: YTN; PAM sequence: CTG
agacattcctataaaattag

SEQ ID NO: 304005 - DNA, 20 bp, Artificial Sequence
  Description of Artificial Sequence: Synthetic oligonucleotide
  Target: ATXN1; (+) strand; PAM type: YTN; PAM sequence: TTC
ctataaaattagcttactca

SEQ ID NO: 304006 - DNA, 20 bp, Artificial Sequence
  Description of Artificial Sequence: Synthetic oligonucleotide
  Target: ATXN1; (+) strand; PAM type: YTN; PAM sequence: CTA
taaaattagcttactcactg

SEQ ID NO: 304007 - DNA, 20 bp, Artificial Sequence
  Description of Artificial Sequence: Synthetic oligonucleotide
  Target: ATXN1; (+) strand; PAM type: YTN; PAM sequence: TTA
gcttactcactgaattttta

SEQ ID NO: 304008 - DNA, 20 bp, Artificial Sequence
  Description of Artificial Sequence: Synthetic oligonucleotide
  Target: ATXN1; (+) strand; PAM type: YTN; PAM sequence: CTT
actcactgaatttttaaaaa

SEQ ID NO: 304009 - DNA, 20 bp, Artificial Sequence
  Description of Artificial Sequence: Synthetic oligonucleotide
  Target: ATXN1; (+) strand; PAM type: YTN; PAM sequence: TTA
ctcactgaatttttaaaaag

SEQ ID NO: 304010 - DNA, 20 bp, Artificial Sequence
  Description of Artificial Sequence: Synthetic oligonucleotide
  Target: ATXN1; (+) strand; PAM type: YTN; PAM sequence: CTC
actgaatttttaaaaaggag

SEQ ID NO: 304011 - DNA, 20 bp, Artificial Sequence
  Description of Artificial Sequence: Synthetic oligonucleotide
  Target: ATXN1; (+) strand; PAM type: YTN; PAM sequence: CTG
aatttttaaaaaggagaaca

SEQ ID NO: 304012 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaggagaacaaagcc

SEQ ID NO: 304013 - DNA, 20 bp, Artificial Sequence
  Description of Artificial Sequence: Synthetic oligonucleotide
  Target: ATXN1; (+) strand; PAM type: YTN; PAM sequence: TTT
taaaaaggagaacaaagcca

SEQ ID NO: 304014 - DNA, 20 bp, Artificial Sequence
  Description of Artificial Sequence: Synthetic oligonucleotide
  Target: ATXN1; (+) strand; PAM type: YTN; PAM sequence: TTT
aaaaaggagaacaaagccaa

SEQ ID NO: 304015 - DNA, 20 bp, Artificial Sequence
  Description of Artificial Sequence: Synthetic oligonucleotide
  Target: ATXN1; (+) strand; PAM type: YTN; PAM sequence: TTA
aaaaggagaacaaagccaaa

SEQ ID NO: 304016 - DNA, 20 bp, Artificial Sequence
  Description of Artificial Sequence: Synthetic oligonucleotide
  Target: ATXN1; (+) strand; PAM type: YTN; PAM sequence: TTG
gcctctgggggcgtatgtgt

SEQ ID NO: 304017 - DNA, 20 bp, Artificial Sequence
  Description of Artificial Sequence: Synthetic oligonucleotide
  Target: ATXN1; (+) strand; PAM type: YTN; PAM sequence: CTC
tgggggcgtatgtgtgtgaa

SEQ ID NO: 304018 - DNA, 20 bp, Artificial Sequence
  Description of Artificial Sequence: Synthetic oligonucleotide
  Target: ATXN1; (+) strand; PAM type: YTN; PAM sequence: CTG
ggggcgtatgtgtgtgaaca

SEQ ID NO: 304019 - DNA, 20 bp, Artificial Sequence
  Description of Artificial Sequence: Synthetic oligonucleotide
  Target: ATXN1; (+) strand; PAM type: YTN; PAM sequence: CTG
atgctgtgtagaaatgatgt

SEQ ID NO: 304020 - DNA, 20 bp, Artificial Sequence
  Description of Artificial Sequence: Synthetic oligonucleotide
  Target: ATXN1; (+) strand; PAM type: YTN; PAM sequence: CTG
tgtagaaatgatgtgtcaat

SEQ ID NO: 304021 - DNA, 20 bp, Artificial Sequence
  Description of Artificial Sequence: Synthetic oligonucleotide
  Target: ATXN1; (+) strand; PAM type: YTN; PAM sequence: TTT
gggctacttgtgtgaaaact

SEQ ID NO: 304022 - DNA, 20 bp, Artificial Sequence
  Description of Artificial Sequence: Synthetic oligonucleotide
  Target: ATXN1; (+) strand; PAM type: YTN; PAM sequence: TTG
ggctacttgtgtgaaaactg

SEQ ID NO: 304023 - DNA, 20 bp, Artificial Sequence
  Description of Artificial Sequence: Synthetic oligonucleotide
  Target: ATXN1; (+) strand; PAM type: YTN; PAM sequence: CTA
cttgtgtgaaaactgctcaa

SEQ ID NO: 304024 - DNA, 20 bp, Artificial Sequence
  Description of Artificial Sequence: Synthetic oligonucleotide
  Target: ATXN1; (+) strand; PAM type: YTN; PAM sequence: CTT
gtgtgaaaactgctcaatcc

SEQ ID NO: 304025 - DNA, 20 bp, Artificial Sequence
  Description of Artificial Sequence: Synthetic oligonucleotide
  Target: ATXN1; (+) strand; PAM type: YTN; PAM sequence: TTG
tgtgaaaactgctcaatcca

SEQ ID NO: 304026 - DNA, 20 bp, Artificial Sequence
  Description of Artificial Sequence: Synthetic oligonucleotide
  Target: ATXN1; (+) strand; PAM type: YTN; PAM sequence: CTG
ctcaatccaagagttacttc

SEQ ID NO: 304027 - DNA, 20 bp, Artificial Sequence
  Description of Artificial Sequence: Synthetic oligonucleotide
  Target: ATXN1; (+) strand; PAM type: YTN; PAM sequence: CTC
aatccaagagttacttcttg

SEQ ID NO: 304028 - DNA, 20 bp, Artificial Sequence
  Description of Artificial Sequence: Synthetic oligonucleotide
  Target: ATXN1; (+) strand; PAM type: YTN; PAM sequence: TTA
cttcttgtttctactgactg

SEQ ID NO: 304029 - DNA, 20 bp, Artificial Sequence
  Description of Artificial Sequence: Synthetic oligonucleotide
  Target: ATXN1; (+) strand; PAM type: YTN; PAM sequence: CTT
cttgtttctactgactgaac

SEQ ID NO: 304030 - DNA, 20 bp, Artificial Sequence
  Description of Artificial Sequence: Synthetic oligonucleotide
  Target: ATXN1; (+) strand; PAM type: YTN; PAM sequence: TTC
ttgtttctactgactgaaca

SEQ ID NO: 304031 - DNA, 20 bp, Artificial Sequence
  Description of Artificial Sequence: Synthetic oligonucleotide
  Target: ATXN1; (+) strand; PAM type: YTN; PAM sequence: CTT
gtttctactgactgaacatg

SEQ ID NO: 304032 - DNA, 20 bp, Artificial Sequence
  Description of Artificial Sequence: Synthetic oligonucleotide
  Target: ATXN1; (+) strand; PAM type: YTN; PAM sequence: TTG
tttctactgactgaacatga

SEQ ID NO: 304033 - DNA, 20 bp, Artificial Sequence
  Description of Artificial Sequence: Synthetic oligonucleotide
  Target: ATXN1; (+) strand; PAM type: YTN; PAM sequence: TTT
ctactgactgaacatgaaga

SEQ ID NO: 304034 - DNA, 20 bp, Artificial Sequence
  Description of Artificial Sequence: Synthetic oligonucleotide
  Target: ATXN1; (+) strand; PAM type: YTN; PAM sequence: TTC
tactgactgaacatgaagag

SEQ ID NO: 304035 - DNA, 20 bp, Artificial Sequence
  Description of Artificial Sequence: Synthetic oligonucleotide
  Target: ATXN1; (+) strand; PAM type: YTN; PAM sequence: CTA
ctgactgaacatgaagagag

SEQ ID NO: 304036 - DNA, 20 bp, Artificial Sequence
  Description of Artificial Sequence: Synthetic oligonucleotide
  Target: ATXN1; (+) strand; PAM type: YTN; PAM sequence: CTG
actgaacatgaagagagaac

SEQ ID NO: 304037 - DNA, 20 bp, Artificial Sequence
  Description of Artificial Sequence: Synthetic oligonucleotide
  Target: ATXN1; (+) strand; PAM type: YTN; PAM sequence: CTG
aacatgaagagagaaccaaa

SEQ ID NO: 304038 - DNA, 20 bp, Artificial Sequence
  Description of Artificial Sequence: Synthetic oligonucleotide
  Target: ATXN1; (+) strand; PAM type: YTN; PAM sequence: TTC
cagacagggaaagaatctga

SEQ ID NO: 304039 - DNA, 20 bp, Artificial Sequence
  Description of Artificial Sequence: Synthetic oligonucleotide
  Target: ATXN1; (+) strand; PAM type: YTN; PAM sequence: CTG
agaaaacatagagtggagtg

SEQ ID NO: 304040 - DNA, 20 bp, Artificial Sequence
  Description of Artificial Sequence: Synthetic oligonucleotide
  Target: ATXN1; (+) strand; PAM type: YTN; PAM sequence: TTT
cagtgtgtgtatatgaagaa

SEQ ID NO: 304041 - DNA, 20 bp, Artificial Sequence
  Description of Artificial Sequence: Synthetic oligonucleotide
  Target: ATXN1; (+) strand; PAM type: YTN; PAM sequence: TTC
agtgtgtgtatatgaagaag

SEQ ID NO: 304042 - DNA, 20 bp, Artificial Sequence
  Description of Artificial Sequence: Synthetic oligonucleotide
  Target: ATXN1; (+) strand; PAM type: YTN; PAM sequence: CTG
gatgcttttcatcctccatg

SEQ ID NO: 304043 - DNA, 20 bp, Artificial Sequence
  Description of Artificial Sequence: Synthetic oligonucleotide
  Target: ATXN1; (+) strand; PAM type: YTN; PAM sequence: CTT
ttcatcctccatgcagttct

SEQ ID NO: 304044 - DNA, 20 bp, Artificial Sequence
  Description of Artificial Sequence: Synthetic oligonucleotide
  Target: ATXN1; (+) strand; PAM type: YTN; PAM sequence: TTT
tcatcctccatgcagttctc

SEQ ID NO: 304045 - DNA, 20 bp, Artificial Sequence
  Description of Artificial Sequence: Synthetic oligonucleotide
  Target: ATXN1; (+) strand; PAM type: YTN; PAM sequence: TTT
catcctccatgcagttctcc

SEQ ID NO: 304046 - DNA, 20 bp, Artificial Sequence
  Description of Artificial Sequence: Synthetic oligonucleotide
  Target: ATXN1; (+) strand; PAM type: YTN; PAM sequence: TTC
atcctccatgcagttctcca

SEQ ID NO: 304047 - DNA, 20 bp, Artificial Sequence
  Description of Artificial Sequence: Synthetic oligonucleotide
  Target: ATXN1; (+) strand; PAM type: YTN; PAM sequence: CTC
catgcagttctccacccgct

SEQ ID NO: 304048 - DNA, 20 bp, Artificial Sequence
  Description of Artificial Sequence: Synthetic oligonucleotide
  Target: ATXN1; (+) strand; PAM type: YTN; PAM sequence: TTC
tccacccgcttactacccct

SEQ ID NO: 304049 - DNA, 20 bp, Artificial Sequence
  Description of Artificial Sequence: Synthetic oligonucleotide
  Target: ATXN1; (+) strand; PAM type: YTN; PAM sequence: CTC
cacccgcttactacccctca

SEQ ID NO: 304050 - DNA, 20 bp, Artificial Sequence
  Description of Artificial Sequence: Synthetic oligonucleotide
  Target: ATXN1; (+) strand; PAM type: YTN; PAM sequence: CTT
actacccctcacttaaagtg

SEQ ID NO: 304051 - DNA, 20 bp, Artificial Sequence
  Description of Artificial Sequence: Synthetic oligonucleotide
  Target: ATXN1; (+) strand; PAM type: YTN; PAM sequence: TTA
ctacccctcacttaaagtgt

SEQ ID NO: 304052 - DNA, 20 bp, Artificial Sequence
  Description of Artificial Sequence: Synthetic oligonucleotide
  Target: ATXN1; (+) strand; PAM type: YTN; PAM sequence: CTA
cccctcacttaaagtgtggt

SEQ ID NO: 304053 - DNA, 20 bp, Artificial Sequence
  Description of Artificial Sequence: Synthetic oligonucleotide
  Target: ATXN1; (+) strand; PAM type: YTN; PAM sequence: CTC
acttaaagtgtggtcctggg

SEQ ID NO: 304054 - DNA, 20 bp, Artificial Sequence
  Description of Artificial Sequence: Synthetic oligonucleotide
  Target: ATXN1; (+) strand; PAM type: YTN; PAM sequence: CTT
aaagtgtggtcctggggcca

SEQ ID NO: 304055 - DNA, 20 bp, Artificial Sequence
  Description of Artificial Sequence: Synthetic oligonucleotide
  Target: ATXN1; (+) strand; PAM type: YTN; PAM sequence: TTA
aagtgtggtcctggggccag

SEQ ID NO: 304056 - DNA, 20 bp, Artificial Sequence
  Description of Artificial Sequence: Synthetic oligonucleotide
  Target: ATXN1; (+) strand; PAM type: YTN; PAM sequence: CTG
gggccagcagcatcagtttc

SEQ ID NO: 304057 - DNA, 20 bp, Artificial Sequence
  Description of Artificial Sequence: Synthetic oligonucleotide
  Target: ATXN1; (+) strand; PAM type: YTN; PAM sequence: TTT
cacggagggatttgtcagaa

SEQ ID NO: 304058 - DNA, 20 bp, Artificial Sequence
  Description of Artificial Sequence: Synthetic oligonucleotide
  Target: ATXN1; (+) strand; PAM type: YTN; PAM sequence: TTC
acggagggatttgtcagaaa

SEQ ID NO: 304059 - DNA, 20 bp, Artificial Sequence
  Description of Artificial Sequence: Synthetic oligonucleotide
  Target: ATXN1; (+) strand; PAM type: YTN; PAM sequence: TTT
gtcagaaatacatattctca

SEQ ID NO: 304060 - DNA, 20 bp, Artificial Sequence
  Description of Artificial Sequence: Synthetic oligonucleotide
  Target: ATXN1; (+) strand; PAM type: YTN; PAM sequence: TTG
tcagaaatacatattctcag

SEQ ID NO: 304061 - DNA, 20 bp, Artificial Sequence
  Description of Artificial Sequence: Synthetic oligonucleotide
  Target: ATXN1; (+) strand; PAM type: YTN; PAM sequence: TTC
tcaggctccaccctagaact

SEQ ID NO: 304062 - DNA, 20 bp, Artificial Sequence
  Description of Artificial Sequence: Synthetic oligonucleotide
  Target: ATXN1; (+) strand; PAM type: YTN; PAM sequence: CTC
aggctccaccctagaactat

SEQ ID NO: 304063 - DNA, 20 bp, Artificial Sequence
  Description of Artificial Sequence: Synthetic oligonucleotide
  Target: ATXN1; (+) strand; PAM type: YTN; PAM sequence: CTC
caccctagaactattaaatc

SEQ ID NO: 304064 - DNA, 20 bp, Artificial Sequence
  Description of Artificial Sequence: Synthetic oligonucleotide
  Target: ATXN1; (+) strand; PAM type: YTN; PAM sequence: CTA
gaactattaaatcagaaccc

SEQ ID NO: 304065 - DNA, 20 bp, Artificial Sequence
  Description of Artificial Sequence: Synthetic oligonucleotide
  Target: ATXN1; (+) strand; PAM type: YTN; PAM sequence: CTA
ttaaatcagaacccctgggc

SEQ ID NO: 304066 - DNA, 20 bp, Artificial Sequence
  Description of Artificial Sequence: Synthetic oligonucleotide
  Target: ATXN1; (+) strand; PAM type: YTN; PAM sequence: TTA
aatcagaacccctgggcctg

SEQ ID NO: 304067 - DNA, 20 bp, Artificial Sequence
  Description of Artificial Sequence: Synthetic oligonucleotide
  Target: ATXN1; (+) strand; PAM type: YTN; PAM sequence: CTG
ggcctggcgcccagaaatct

SEQ ID NO: 304068 - DNA, 20 bp, Artificial Sequence
  Description of Artificial Sequence: Synthetic oligonucleotide
  Target: ATXN1; (+) strand; PAM type: YTN; PAM sequence: CTG
gcgcccagaaatctgtggtc

SEQ ID NO: 304069 - DNA, 20 bp, Artificial Sequence
  Description of Artificial Sequence: Synthetic oligonucleotide
  Target: ATXN1; (+) strand; PAM type: YTN; PAM sequence: CTG
tggtctaaacaagccttcca

SEQ ID NO: 304070 - DNA, 20 bp, Artificial Sequence
  Description of Artificial Sequence: Synthetic oligonucleotide
  Target: ATXN1; (+) strand; PAM type: YTN; PAM sequence: CTA
aacaagccttccaggtgcct

SEQ ID NO: 304071 - DNA, 20 bp, Artificial Sequence
  Description of Artificial Sequence: Synthetic oligonucleotide
  Target: ATXN1; (+) strand; PAM type: YTN; PAM sequence: CTT
ccaggtgcctctgatgcaaa

SEQ ID NO: 304072 - DNA, 20 bp, Artificial Sequence
  Description of Artificial Sequence: Synthetic oligonucleotide
  Target: ATXN1; (+) strand; PAM type: YTN; PAM sequence: TTC
caggtgcctctgatgcaaac

SEQ ID NO: 304073 - DNA, 20 bp, Artificial Sequence
  Description of Artificial Sequence: Synthetic oligonucleotide
  Target: ATXN1; (+) strand; PAM type: YTN; PAM sequence: CTC
tgatgcaaacattcaataaa

SEQ ID NO: 304074 - DNA, 20 bp, Artificial Sequence
  Description of Artificial Sequence: Synthetic oligonucleotide
  Target: ATXN1; (+) strand; PAM type: YTN; PAM sequence: CTG
atgcaaacattcaataaaat

SEQ ID NO: 304075 - DNA, 20 bp, Artificial Sequence
  Description of Artificial Sequence: Synthetic oligonucleotide
  Target: ATXN1; (+) strand; PAM type: YTN; PAM sequence: TTC
aataaaatgtaatcgtcaaa

SEQ ID NO: 304076 - DNA, 20 bp, Artificial Sequence
  Description of Artificial Sequence: Synthetic oligonucleotide
  Target: ATXN1; (+) strand; PAM type: YTN; PAM sequence: CTT
aactggtccctggccgcgcg

SEQ ID NO: 304077 - DNA, 20 bp, Artificial Sequence
  Description of Artificial Sequence: Synthetic oligonucleotide
  Target: ATXN1; (+) strand; PAM type: YTN; PAM sequence: TTA
actggtccctggccgcgcgt

SEQ ID NO: 304078 - DNA, 20 bp, Artificial Sequence
  Description of Artificial Sequence: Synthetic oligonucleotide
  Target: ATXN1; (+) strand; PAM type: YTN; PAM sequence: CTG
gtccctggccgcgcgtagta

SEQ ID NO: 304079 - DNA, 20 bp, Artificial Sequence
  Description of Artificial Sequence: Synthetic oligonucleotide
  Target: ATXN1; (+) strand; PAM type: YTN; PAM sequence: CTG
gccgcgcgtagtaactcatg

SEQ ID NO: 304080 - DNA, 20 bp, Artificial Sequence
  Description of Artificial Sequence: Synthetic oligonucleotide
  Target: ATXN1; (+) strand; PAM type: YTN; PAM sequence: CTC
atgcctataatcccagtact

SEQ ID NO: 304081 - DNA, 20 bp, Artificial Sequence
  Description of Artificial Sequence: Synthetic oligonucleotide
  Target: ATXN1; (+) strand; PAM type: YTN; PAM sequence: CTA
taatcccagtactttgggag

SEQ ID NO: 304082 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaagcgggtgg

SEQ ID NO: 304083 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaagcgggtgga

SEQ ID NO: 304084 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaagcgggtggat

SEQ ID NO: 304085 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctggccaacat

SEQ ID NO: 304086 - DNA, 20 bp, Artificial Sequence
  Description of Artificial Sequence: Synthetic oligonucleotide
  Target: ATXN1; (+) strand; PAM type: YTN; PAM sequence: TTG
agaccagcctggccaacatg

SEQ ID NO: 304087 - DNA, 20 bp, Artificial Sequence
  Description of Artificial Sequence: Synthetic oligonucleotide
  Target: ATXN1; (+) strand; PAM type: YTN; PAM sequence: CTG
gccaacatgtgaaatctcgt

SEQ ID NO: 304088 - DNA, 20 bp, Artificial Sequence
  Description of Artificial Sequence: Synthetic oligonucleotide
  Target: ATXN1; (+) strand; PAM type: YTN; PAM sequence: CTC
gtctttataaaaatacaaaa

SEQ ID NO: 304089 - DNA, 20 bp, Artificial Sequence
  Description of Artificial Sequence: Synthetic oligonucleotide
  Target: ATXN1; (+) strand; PAM type: YTN; PAM sequence: CTT
tataaaaatacaaaaattag

SEQ ID NO: 304090 - DNA, 20 bp, Artificial Sequence
  Description of Artificial Sequence: Synthetic oligonucleotide
  Target: ATXN1; (+) strand; PAM type: YTN; PAM sequence: TTT
ataaaaatacaaaaattagc

SEQ ID NO: 304091 - DNA, 20 bp, Artificial Sequence
  Description of Artificial Sequence: Synthetic oligonucleotide
  Target: ATXN1; (+) strand; PAM type: YTN; PAM sequence: TTA
taaaaatacaaaaattagcc

SEQ ID NO: 304092 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtggtggtgtgca

SEQ ID NO: 304093 - DNA, 20 bp, Artificial Sequence
  Description of Artificial Sequence: Synthetic oligonucleotide
  Target: ATXN1; (+) strand; PAM type: YTN; PAM sequence: CTC
tagtcccagctacttgggag

SEQ ID NO: 304094 - DNA, 20 bp, Artificial Sequence
  Description of Artificial Sequence: Synthetic oligonucleotide
  Target: ATXN1; (+) strand; PAM type: YTN; PAM sequence: CTA
gtcccagctacttgggaggt

SEQ ID NO: 304095 - DNA, 20 bp, Artificial Sequence
  Description of Artificial Sequence: Synthetic oligonucleotide
  Target: ATXN1; (+) strand; PAM type: YTN; PAM sequence: CTA
cttgggaggttgaggcagag

SEQ ID NO: 304096 - DNA, 20 bp, Artificial Sequence
  Description of Artificial Sequence: Synthetic oligonucleotide
  Target: ATXN1; (+) strand; PAM type: YTN; PAM sequence: CTT
gggaggttgaggcagagaat

SEQ ID NO: 304097 - DNA, 20 bp, Artificial Sequence
  Description of Artificial Sequence: Synthetic oligonucleotide
  Target: ATXN1; (+) strand; PAM type: YTN; PAM sequence: TTG
ggaggttgaggcagagaatc

SEQ ID NO: 304098 - DNA, 20 bp, Artificial Sequence
  Description of Artificial Sequence: Synthetic oligonucleotide
  Target: ATXN1; (+) strand; PAM type: YTN; PAM sequence: TTG
aggcagagaatcacttgaac

SEQ ID NO: 304099 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcggaggtt

SEQ ID NO: 304100 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcggaggttg

SEQ ID NO: 304101 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcacacc

SEQ ID NO: 304102 - DNA, 20 bp, Artificial Sequence
  Description of Artificial Sequence: Synthetic oligonucleotide
  Target: ATXN1; (+) strand; PAM type: YTN; PAM sequence: CTC
catgccagcctgggcgacag

SEQ ID NO: 304103 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagtaagactgta

SEQ ID NO: 304104 - DNA, 20 bp, Artificial Sequence
  Description of Artificial Sequence: Synthetic oligonucleotide
  Target: ATXN1; (+) strand; PAM type: YTN; PAM sequence: CTG
tagaaaaaaagaaagaaaaa

SEQ ID NO: 304105 - DNA, 20 bp, Artificial Sequence
  Description of Artificial Sequence: Synthetic oligonucleotide
  Target: ATXN1; (+) strand; PAM type: YTN; PAM sequence: CTG
gccccatttgcatgtactac

SEQ ID NO: 304106 - DNA, 20 bp, Artificial Sequence
  Description of Artificial Sequence: Synthetic oligonucleotide
  Target: ATXN1; (+) strand; PAM type: YTN; PAM sequence: TTT
gcatgtactactgctacact

SEQ ID NO: 304107 - DNA, 20 bp, Artificial Sequence
  Description of Artificial Sequence: Synthetic oligonucleotide
  Target: ATXN1; (+) strand; PAM type: YTN; PAM sequence: TTG
catgtactactgctacactc

SEQ ID NO: 304108 - DNA, 20 bp, Artificial Sequence
  Description of Artificial Sequence: Synthetic oligonucleotide
  Target: ATXN1; (+) strand; PAM type: YTN; PAM sequence: CTA
ctgctacactcatccctcac

SEQ ID NO: 304109 - DNA, 20 bp, Artificial Sequence
  Description of Artificial Sequence: Synthetic oligonucleotide
  Target: ATXN1; (+) strand; PAM type: YTN; PAM sequence: CTG
ctacactcatccctcactcc

SEQ ID NO: 304110 - DNA, 20 bp, Artificial Sequence
  Description of Artificial Sequence: Synthetic oligonucleotide
  Target: ATXN1; (+) strand; PAM type: YTN; PAM sequence: CTA
cactcatccctcactcccac

SEQ ID NO: 304111 - DNA, 20 bp, Artificial Sequence
  Description of Artificial Sequence: Synthetic oligonucleotide
  Target: ATXN1; (+) strand; PAM type: YTN; PAM sequence: CTC
atccctcactcccacccacc

SEQ ID NO: 304112 - DNA, 20 bp, Artificial Sequence
  Description of Artificial Sequence: Synthetic oligonucleotide
  Target: ATXN1; (+) strand; PAM type: YTN; PAM sequence: CTC
actcccacccacctttcgga

SEQ ID NO: 304113 - DNA, 20 bp, Artificial Sequence
  Description of Artificial Sequence: Synthetic oligonucleotide
  Target: ATXN1; (+) strand; PAM type: YTN; PAM sequence: CTC
ccacccacctttcggaggta

SEQ ID NO: 304114 - DNA, 20 bp, Artificial Sequence
  Description of Artificial Sequence: Synthetic oligonucleotide
  Target: ATXN1; (+) strand; PAM type: YTN; PAM sequence: CTT
tcggaggtaggccgcccatc

SEQ ID NO: 304115 - DNA, 20 bp, Artificial Sequence
  Description of Artificial Sequence: Synthetic oligonucleotide
  Target: ATXN1; (+) strand; PAM type: YTN; PAM sequence: TTT
cggaggtaggccgcccatca

SEQ ID NO: 304116 - DNA, 20 bp, Artificial Sequence
  Description of Artificial Sequence: Synthetic oligonucleotide
  Target: ATXN1; (+) strand; PAM type: YTN; PAM sequence: TTC
ggaggtaggccgcccatcac

SEQ ID NO: 304117 - DNA, 20 bp, Artificial Sequence
  Description of Artificial Sequence: Synthetic oligonucleotide
  Target: ATXN1; (+) strand; PAM type: YTN; PAM sequence: CTA
gatttagcagagcatccgct

SEQ ID NO: 304118 - DNA, 20 bp, Artificial Sequence
  Description of Artificial Sequence: Synthetic oligonucleotide
  Target: ATXN1; (+) strand; PAM type: YTN; PAM sequence: TTT
agcagagcatccgctgactg

SEQ ID NO: 304119 - DNA, 20 bp, Artificial Sequence
  Description of Artificial Sequence: Synthetic oligonucleotide
  Target: ATXN1; (+) strand; PAM type: YTN; PAM sequence: TTA
gcagagcatccgctgactga

SEQ ID NO: 304120 - DNA, 20 bp, Artificial Sequence
  Description of Artificial Sequence: Synthetic oligonucleotide
  Target: ATXN1; (+) strand; PAM type: YTN; PAM sequence: CTG
actgaaatgagacacagctg

SEQ ID NO: 304121 - DNA, 20 bp, Artificial Sequence
  Description of Artificial Sequence: Synthetic oligonucleotide
  Target: ATXN1; (+) strand; PAM type: YTN; PAM sequence: CTG
aaatgagacacagctgggag

SEQ ID NO: 304122 - DNA, 20 bp, Artificial Sequence
  Description of Artificial Sequence: Synthetic oligonucleotide
  Target: ATXN1; (+) strand; PAM type: YTN; PAM sequence: CTG
ggaggcacccaccaccaccc

SEQ ID NO: 304123 - DNA, 20 bp, Artificial Sequence
  Description of Artificial Sequence: Synthetic oligonucleotide
  Target: ATXN1; (+) strand; PAM type: YTN; PAM sequence: CTT
tgtagaacagctacccaaaa

SEQ ID NO: 304124 - DNA, 20 bp, Artificial Sequence
  Description of Artificial Sequence: Synthetic oligonucleotide
  Target: ATXN1; (+) strand; PAM type: YTN; PAM sequence: TTT
gtagaacagctacccaaaaa

SEQ ID NO: 304125 - DNA, 20 bp, Artificial Sequence
  Description of Artificial Sequence: Synthetic oligonucleotide
  Target: ATXN1; (+) strand; PAM type: YTN; PAM sequence: TTG
tagaacagctacccaaaaag

SEQ ID NO: 304126 - DNA, 20 bp, Artificial Sequence
  Description of Artificial Sequence: Synthetic oligonucleotide
  Target: ATXN1; (+) strand; PAM type: YTN; PAM sequence: CTA
cccaaaaagacaaggatagc

SEQ ID NO: 304127 - DNA, 20 bp, Artificial Sequence
  Description of Artificial Sequence: Synthetic oligonucleotide
  Target: ATXN1; (+) strand; PAM type: YTN; PAM sequence: CTG
aagcttttccaatctattcc

SEQ ID NO: 304128 - DNA, 20 bp, Artificial Sequence
  Description of Artificial Sequence: Synthetic oligonucleotide
  Target: ATXN1; (+) strand; PAM type: YTN; PAM sequence: CTT
ttccaatctattcctttttg

SEQ ID NO: 304129 - DNA, 20 bp, Artificial Sequence
  Description of Artificial Sequence: Synthetic oligonucleotide
  Target: ATXN1; (+) strand; PAM type: YTN; PAM sequence: TTT
tccaatctattcctttttgt

SEQ ID NO: 304130 - DNA, 20 bp, Artificial Sequence
  Description of Artificial Sequence: Synthetic oligonucleotide
  Target: ATXN1; (+) strand; PAM type: YTN; PAM sequence: TTT
ccaatctattcctttttgtg

SEQ ID NO: 304131 - DNA, 20 bp, Artificial Sequence
  Description of Artificial Sequence: Synthetic oligonucleotide
  Target: ATXN1; (+) strand; PAM type: YTN; PAM sequence: TTC
caatctattcctttttgtga

SEQ ID NO: 304132 - DNA, 20 bp, Artificial Sequence
  Description of Artificial Sequence: Synthetic oligonucleotide
  Target: ATXN1; (+) strand; PAM type: YTN; PAM sequence: CTA
ttcctttttgtgattgtttt

SEQ ID NO: 304133 - DNA, 20 bp, Artificial Sequence
  Description of Artificial Sequence: Synthetic oligonucleotide
  Target: ATXN1; (+) strand; PAM type: YTN; PAM sequence: TTC
ctttttgtgattgttttcct

SEQ ID NO: 304134 - DNA, 20 bp, Artificial Sequence
  Description of Artificial Sequence: Synthetic oligonucleotide
  Target: ATXN1; (+) strand; PAM type: YTN; PAM sequence: CTT
tttgtgattgttttcctttt

SEQ ID NO: 304135 - DNA, 20 bp, Artificial Sequence
  Description of Artificial Sequence: Synthetic oligonucleotide
  Target: ATXN1; (+) strand; PAM type: YTN; PAM sequence: TTT
ttgtgattgttttccttttg

SEQ ID NO: 304136 - DNA, 20 bp, Artificial Sequence
  Description of Artificial Sequence: Synthetic oligonucleotide
  Target: ATXN1; (+) strand; PAM type: YTN; PAM sequence: TTT
tgtgattgttttccttttga

SEQ ID NO: 304137 - DNA, 20 bp, Artificial Sequence
  Description of Artificial Sequence: Synthetic oligonucleotide
  Target: ATXN1; (+) strand; PAM type: YTN; PAM sequence: TTT
gtgattgttttccttttgaa

SEQ ID NO: 304138 - DNA, 20 bp, Artificial Sequence
  Description of Artificial Sequence: Synthetic oligonucleotide
  Target: ATXN1; (+) strand; PAM type: YTN; PAM sequence: TTG
tgattgttttccttttgaaa

SEQ ID NO: 304139 - DNA, 20 bp, Artificial Sequence
  Description of Artificial Sequence: Synthetic oligonucleotide
  Target: ATXN1; (+) strand; PAM type: YTN; PAM sequence: TTG
ttttccttttgaaatagtgt

SEQ ID NO: 304140 - DNA, 20 bp, Artificial Sequence
  Description of Artificial Sequence: Synthetic oligonucleotide
  Target: ATXN1; (+) strand; PAM type: YTN; PAM sequence: TTT
tccttttgaaatagtgttaa

SEQ ID NO: 304141 - DNA, 20 bp, Artificial Sequence
  Description of Artificial Sequence: Synthetic oligonucleotide
  Target: ATXN1; (+) strand; PAM type: YTN; PAM sequence: TTT
ccttttgaaatagtgttaac

SEQ ID NO: 304142 - DNA, 20 bp, Artificial Sequence
  Description of Artificial Sequence: Synthetic oligonucleotide
  Target: ATXN1; (+) strand; PAM type: YTN; PAM sequence: TTC
cttttgaaatagtgttaaca

SEQ ID NO: 304143 - DNA, 20 bp, Artificial Sequence
  Description of Artificial Sequence: Synthetic oligonucleotide
  Target: ATXN1; (+) strand; PAM type: YTN; PAM sequence: CTT
ttgaaatagtgttaacacat

SEQ ID NO: 304144 - DNA, 20 bp, Artificial Sequence
  Description of Artificial Sequence: Synthetic oligonucleotide
  Target: ATXN1; (+) strand; PAM type: YTN; PAM sequence: TTT
tgaaatagtgttaacacatt

SEQ ID NO: 304145 - DNA, 20 bp, Artificial Sequence
  Description of Artificial Sequence: Synthetic oligonucleotide
  Target: ATXN1; (+) strand; PAM type: YTN; PAM sequence: TTT
gaaatagtgttaacacattt

SEQ ID NO: 304146 - DNA, 20 bp, Artificial Sequence
  Description of Artificial Sequence: Synthetic oligonucleotide
  Target: ATXN1; (+) strand; PAM type: YTN; PAM sequence: TTG
aaatagtgttaacacatttt

SEQ ID NO: 304147 - DNA, 20 bp, Artificial Sequence
  Description of Artificial Sequence: Synthetic oligonucleotide
  Target: ATXN1; (+) strand; PAM type: YTN; PAM sequence: TTA
acacattttaaaattatata

SEQ ID NO: 304148 - DNA, 20 bp, Artificial Sequence
  Description of Artificial Sequence: Synthetic oligonucleotide
  Target: ATXN1; (+) strand; PAM type: YTN; PAM sequence: TTT
taaaattatatacatattca

SEQ ID NO: 304149 - DNA, 20 bp, Artificial Sequence
  Description of Artificial Sequence: Synthetic oligonucleotide
  Target: ATXN1; (+) strand; PAM type: YTN; PAM sequence: TTT
aaaattatatacatattcat

SEQ ID NO: 304150 - DNA, 20 bp, Artificial Sequence
  Description of Artificial Sequence: Synthetic oligonucleotide
  Target: ATXN1; (+) strand; PAM type: YTN; PAM sequence: TTA
aaattatatacatattcatt

SEQ ID NO: 304151 - DNA, 20 bp, Artificial Sequence
  Description of Artificial Sequence: Synthetic oligonucleotide
  Target: ATXN1; (+) strand; PAM type: YTN; PAM sequence: TTA
tatacatattcattttgaaa

SEQ ID NO: 304152 - DNA, 20 bp, Artificial Sequence
  Description of Artificial Sequence: Synthetic oligonucleotide
  Target: ATXN1; (+) strand; PAM type: YTN; PAM sequence: TTC
attttgaaaaatacagaaat

SEQ ID NO: 304153 - DNA, 20 bp, Artificial Sequence
  Description of Artificial Sequence: Synthetic oligonucleotide
  Target: ATXN1; (+) strand; PAM type: YTN; PAM sequence: TTT
tgaaaaatacagaaatggca

SEQ ID NO: 304154 - DNA, 20 bp, Artificial Sequence
  Description of Artificial Sequence: Synthetic oligonucleotide
  Target: ATXN1; (+) strand; PAM type: YTN; PAM sequence: TTT
gaaaaatacagaaatggcaa

SEQ ID NO: 304155 - DNA, 20 bp, Artificial Sequence
  Description of Artificial Sequence: Synthetic oligonucleotide
  Target: ATXN1; (+) strand; PAM type: YTN; PAM sequence: TTG
aaaaatacagaaatggcaaa

SEQ ID NO: 304156 - DNA, 20 bp, Artificial Sequence
  Description of Artificial Sequence: Synthetic oligonucleotide
  Target: ATXN1; (+) strand; PAM type: YTN; PAM sequence: CTC
ccagctgacacttaacattt

SEQ ID NO: 304157 - DNA, 20 bp, Artificial Sequence
  Description of Artificial Sequence: Synthetic oligonucleotide
  Target: ATXN1; (+) strand; PAM type: YTN; PAM sequence: CTG
acacttaacatttgtcccat

SEQ ID NO: 304158 - DNA, 20 bp, Artificial Sequence
  Description of Artificial Sequence: Synthetic oligonucleotide
  Target: ATXN1; (+) strand; PAM type: YTN; PAM sequence: CTT
aacatttgtcccatcttttt

SEQ ID NO: 304159 - DNA, 20 bp, Artificial Sequence
  Description of Artificial Sequence: Synthetic oligonucleotide
  Target: ATXN1; (+) strand; PAM type: YTN; PAM sequence: TTA
acatttgtcccatctttttc

SEQ ID NO: 304160 - DNA, 20 bp, Artificial Sequence
  Description of Artificial Sequence: Synthetic oligonucleotide
  Target: ATXN1; (+) strand; PAM type: YTN; PAM sequence: TTT
gtcccatctttttctaagca

SEQ ID NO: 304161 - DNA, 20 bp, Artificial Sequence
  Description of Artificial Sequence: Synthetic oligonucleotide
  Target: ATXN1; (+) strand; PAM type: YTN; PAM sequence: TTG
tcccatctttttctaagcat

SEQ ID NO: 304162 - DNA, 20 bp, Artificial Sequence
  Description of Artificial Sequence: Synthetic oligonucleotide
  Target: ATXN1; (+) strand; PAM type: YTN; PAM sequence: CTT
tttctaagcatcaatatata

SEQ ID NO: 304163 - DNA, 20 bp, Artificial Sequence
  Description of Artificial Sequence: Synthetic oligonucleotide
  Target: ATXN1; (+) strand; PAM type: YTN; PAM sequence: TTT
ttctaagcatcaatatataa

SEQ ID NO: 304164 - DNA, 20 bp, Artificial Sequence
  Description of Artificial Sequence: Synthetic oligonucleotide
  Target: ATXN1; (+) strand; PAM type: YTN; PAM sequence: TTT
tctaagcatcaatatataaa

SEQ ID NO: 304165 - DNA, 20 bp, Artificial Sequence
  Description of Artificial Sequence: Synthetic oligonucleotide
  Target: ATXN1; (+) strand; PAM type: YTN; PAM sequence: TTT
ctaagcatcaatatataaat

SEQ ID NO: 304166 - DNA, 20 bp, Artificial Sequence
  Description of Artificial Sequence: Synthetic oligonucleotide
  Target: ATXN1; (+) strand; PAM type: YTN; PAM sequence: TTC
taagcatcaatatataaata

SEQ ID NO: 304167 - DNA, 20 bp, Artificial Sequence
  Description of Artificial Sequence: Synthetic oligonucleotide
  Target: ATXN1; (+) strand; PAM type: YTN; PAM sequence: CTA
agcatcaatatataaatatt

SEQ ID NO: 304168 - DNA, 20 bp, Artificial Sequence
  Description of Artificial Sequence: Synthetic oligonucleotide
  Target: ATXN1; (+) strand; PAM type: YTN; PAM sequence: TTT
aacagtatatacatgttact

SEQ ID NO: 304169 - DNA, 20 bp, Artificial Sequence
  Description of Artificial Sequence: Synthetic oligonucleotide
  Target: ATXN1; (+) strand; PAM type: YTN; PAM sequence: TTA
acagtatatacatgttactt

SEQ ID NO: 304170 - DNA, 20 bp, Artificial Sequence
  Description of Artificial Sequence: Synthetic oligonucleotide
  Target: ATXN1; (+) strand; PAM type: YTN; PAM sequence: TTA
cttaatttttaaaatttgta

SEQ ID NO: 304171 - DNA, 20 bp, Artificial Sequence
  Description of Artificial Sequence: Synthetic oligonucleotide
  Target: ATXN1; (+) strand; PAM type: YTN; PAM sequence: CTT
aatttttaaaatttgtaatt

SEQ ID NO: 304172 - DNA, 20 bp, Artificial Sequence
  Description of Artificial Sequence: Synthetic oligonucleotide
  Target: ATXN1; (+) strand; PAM type: YTN; PAM sequence: TTA
atttttaaaatttgtaattg

SEQ ID NO: 304173 - DNA, 20 bp, Artificial Sequence
  Description of Artificial Sequence: Synthetic oligonucleotide
  Target: ATXN1; (+) strand; PAM type: YTN; PAM sequence: TTT
ttaaaatttgtaattgtata

SEQ ID NO: 304174 - DNA, 20 bp, Artificial Sequence
  Description of Artificial Sequence: Synthetic oligonucleotide
  Target: ATXN1; (+) strand; PAM type: YTN; PAM sequence: TTT
taaaatttgtaattgtatat

SEQ ID NO: 304175 - DNA, 20 bp, Artificial Sequence
  Description of Artificial Sequence: Synthetic oligonucleotide
  Target: ATXN1; (+) strand; PAM type: YTN; PAM sequence: TTT
aaaatttgtaattgtatatg

SEQ ID NO: 304176 - DNA, 20 bp, Artificial Sequence
  Description of Artificial Sequence: Synthetic oligonucleotide
  Target: ATXN1; (+) strand; PAM type: YTN; PAM sequence: TTA
aaatttgtaattgtatatgt

SEQ ID NO: 304177 - DNA, 20 bp, Artificial Sequence
  Description of Artificial Sequence: Synthetic oligonucleotide
  Target: ATXN1; (+) strand; PAM type: YTN; PAM sequence: TTT
gtaattgtatatgtattttc

SEQ ID NO: 304178 - DNA, 20 bp, Artificial Sequence
  Description of Artificial Sequence: Synthetic oligonucleotide
  Target: ATXN1; (+) strand; PAM type: YTN; PAM sequence: TTG
taattgtatatgtattttct

SEQ ID NO: 304179 - DNA, 20 bp, Artificial Sequence
  Description of Artificial Sequence: Synthetic oligonucleotide
  Target: ATXN1; (+) strand; PAM type: YTN; PAM sequence: TTG
tatatgtattttcttgtata

SEQ ID NO: 304180 - DNA, 20 bp, Artificial Sequence
  Description of Artificial Sequence: Synthetic oligonucleotide
  Target: ATXN1; (+) strand; PAM type: YTN; PAM sequence: TTT
tcttgtatacattcctttga

SEQ ID NO: 304181 - DNA, 20 bp, Artificial Sequence
  Description of Artificial Sequence: Synthetic oligonucleotide
  Target: ATXN1; (+) strand; PAM type: YTN; PAM sequence: TTT
cttgtatacattcctttgaa

SEQ ID NO: 304182 - DNA, 20 bp, Artificial Sequence
  Description of Artificial Sequence: Synthetic oligonucleotide
  Target: ATXN1; (+) strand; PAM type: YTN; PAM sequence: TTC
ttgtatacattcctttgaaa

SEQ ID NO: 304183 - DNA, 20 bp, Artificial Sequence
  Description of Artificial Sequence: Synthetic oligonucleotide
  Target: ATXN1; (+) strand; PAM type: YTN; PAM sequence: CTT
gtatacattcctttgaaagc

SEQ ID NO: 304184 - DNA, 20 bp, Artificial Sequence
  Description of Artificial Sequence: Synthetic oligonucleotide
  Target: ATXN1; (+) strand; PAM type: YTN; PAM sequence: TTG
tatacattcctttgaaagct

SEQ ID NO: 304185 - DNA, 20 bp, Artificial Sequence
  Description of Artificial Sequence: Synthetic oligonucleotide
  Target: ATXN1; (+) strand; PAM type: YTN; PAM sequence: TTC
ctttgaaagctctgtgatgg

SEQ ID NO: 304186 - DNA, 20 bp, Artificial Sequence
  Description of Artificial Sequence: Synthetic oligonucleotide
  Target: ATXN1; (+) strand; PAM type: YTN; PAM sequence: CTT
tgaaagctctgtgatgggtg

SEQ ID NO: 304187 - DNA, 20 bp, Artificial Sequence
  Description of Artificial Sequence: Synthetic oligonucleotide
  Target: ATXN1; (+) strand; PAM type: YTN; PAM sequence: TTT
gaaagctctgtgatgggtgt

SEQ ID NO: 304188 - DNA, 20 bp, Artificial Sequence
  Description of Artificial Sequence: Synthetic oligonucleotide
  Target: ATXN1; (+) strand; PAM type: YTN; PAM sequence: TTG
aaagctctgtgatgggtgta

SEQ ID NO: 304189 - DNA, 20 bp, Artificial Sequence
  Description of Artificial Sequence: Synthetic oligonucleotide
  Target: ATXN1; (+) strand; PAM type: YTN; PAM sequence: CTC
tgtgatgggtgtaggctgaa

SEQ ID NO: 304190 - DNA, 20 bp, Artificial Sequence
  Description of Artificial Sequence: Synthetic oligonucleotide
  Target: ATXN1; (+) strand; PAM type: YTN; PAM sequence: CTG
tgatgggtgtaggctgaact

SEQ ID NO: 304191 - DNA, 20 bp, Artificial Sequence
  Description of Artificial Sequence: Synthetic oligonucleotide
  Target: ATXN1; (+) strand; PAM type: YTN; PAM sequence: CTG
aactgctgggctgtactgtt

SEQ ID NO: 304192 - DNA, 20 bp, Artificial Sequence
  Description of Artificial Sequence: Synthetic oligonucleotide
  Target: ATXN1; (+) strand; PAM type: YTN; PAM sequence: CTG
ctgggctgtactgttttaga

SEQ ID NO: 304193 - DNA, 20 bp, Artificial Sequence
  Description of Artificial Sequence: Synthetic oligonucleotide
  Target: ATXN1; (+) strand; PAM type: YTN; PAM sequence: CTG
ggctgtactgttttagagca

SEQ ID NO: 304194 - DNA, 20 bp, Artificial Sequence
  Description of Artificial Sequence: Synthetic oligonucleotide
  Target: ATXN1; (+) strand; PAM type: YTN; PAM sequence: CTG
tactgttttagagcaaaaaa

SEQ ID NO: 304195 - DNA, 20 bp, Artificial Sequence
  Description of Artificial Sequence: Synthetic oligonucleotide
  Target: ATXN1; (+) strand; PAM type: YTN; PAM sequence: CTG
ttttagagcaaaaaaagata

SEQ ID NO: 304196 - DNA, 20 bp, Artificial Sequence
  Description of Artificial Sequence: Synthetic oligonucleotide
  Target: ATXN1; (+) strand; PAM type: YTN; PAM sequence: TTT
tagagcaaaaaaagatactc

SEQ ID NO: 304197 - DNA, 20 bp, Artificial Sequence
  Description of Artificial Sequence: Synthetic oligonucleotide
  Target: ATXN1; (+) strand; PAM type: YTN; PAM sequence: TTT
agagcaaaaaaagatactca

SEQ ID NO: 304198 - DNA, 20 bp, Artificial Sequence
  Description of Artificial Sequence: Synthetic oligonucleotide
  Target: ATXN1; (+) strand; PAM type: YTN; PAM sequence: TTA
gagcaaaaaaagatactcat

SEQ ID NO: 304199 - DNA, 20 bp, Artificial Sequence
  Description of Artificial Sequence: Synthetic oligonucleotide
  Target: ATXN1; (+) strand; PAM type: YTN; PAM sequence: CTC
atgctgtaattctaattttt

SEQ ID NO: 304200 - DNA, 20 bp, Artificial Sequence
  Description of Artificial Sequence: Synthetic oligonucleotide
  Target: ATXN1; (+) strand; PAM type: YTN; PAM sequence: CTG
taattctaatttttctgtgt

SEQ ID NO: 304201 - DNA, 20 bp, Artificial Sequence
  Description of Artificial Sequence: Synthetic oligonucleotide
  Target: ATXN1; (+) strand; PAM type: YTN; PAM sequence: TTC
taatttttctgtgtttcaaa

SEQ ID NO: 304202 - DNA, 20 bp, Artificial Sequence
  Description of Artificial Sequence: Synthetic oligonucleotide
  Target: ATXN1; (+) strand; PAM type: YTN; PAM sequence: CTA
atttttctgtgtttcaaagg

SEQ ID NO: 304203 - DNA, 20 bp, Artificial Sequence
  Description of Artificial Sequence: Synthetic oligonucleotide
  Target: ATXN1; (+) strand; PAM type: YTN; PAM sequence: TTT
ttctgtgtttcaaagggggg

SEQ ID NO: 304204 - DNA, 20 bp, Artificial Sequence
  Description of Artificial Sequence: Synthetic oligonucleotide
  Target: ATXN1; (+) strand; PAM type: YTN; PAM sequence: TTT
tctgtgtttcaaaggggggg

SEQ ID NO: 304205 - DNA, 20 bp, Artificial Sequence
  Description of Artificial Sequence: Synthetic oligonucleotide
  Target: ATXN1; (+) strand; PAM type: YTN; PAM sequence: TTT
ctgtgtttcaaagggggggc

SEQ ID NO: 304206 - DNA, 20 bp, Artificial Sequence
  Description of Artificial Sequence: Synthetic oligonucleotide
  Target: ATXN1; (+) strand; PAM type: YTN; PAM sequence: TTC
tgtgtttcaaagggggggct

SEQ ID NO: 304207 - DNA, 20 bp, Artificial Sequence
  Description of Artificial Sequence: Synthetic oligonucleotide
  Target: ATXN1; (+) strand; PAM type: YTN; PAM sequence: CTG
tgtttcaaagggggggctat

SEQ ID NO: 304208 - DNA, 20 bp, Artificial Sequence
  Description of Artificial Sequence: Synthetic oligonucleotide
  Target: ATXN1; (+) strand; PAM type: YTN; PAM sequence: TTT
caaagggggggctattaatt

SEQ ID NO: 304209 - DNA, 20 bp, Artificial Sequence
  Description of Artificial Sequence: Synthetic oligonucleotide
  Target: ATXN1; (+) strand; PAM type: YTN; PAM sequence: TTC
aaagggggggctattaattt

SEQ ID NO: 304210 - DNA, 20 bp, Artificial Sequence
  Description of Artificial Sequence: Synthetic oligonucleotide
  Target: ATXN1; (+) strand; PAM type: YTN; PAM sequence: CTA
ttaatttattaaattaattt

SEQ ID NO: 304211 - DNA, 20 bp, Artificial Sequence
  Description of Artificial Sequence: Synthetic oligonucleotide
  Target: ATXN1; (+) strand; PAM type: YTN; PAM sequence: TTA
atttattaaattaattttta

SEQ ID NO: 304212 - DNA, 20 bp, Artificial Sequence
  Description of Artificial Sequence: Synthetic oligonucleotide
  Target: ATXN1; (+) strand; PAM type: YTN; PAM sequence: TTT
attaaattaatttttaaaat

SEQ ID NO: 304213 - DNA, 20 bp, Artificial Sequence
  Description of Artificial Sequence: Synthetic oligonucleotide
  Target: ATXN1; (+) strand; PAM type: YTN; PAM sequence: TTA
ttaaattaatttttaaaatt

SEQ ID NO: 304214 - DNA, 20 bp, Artificial Sequence
  Description of Artificial Sequence: Synthetic oligonucleotide
  Target: ATXN1; (+) strand; PAM type: YTN; PAM sequence: TTA
aattaatttttaaaatttac

SEQ ID NO: 304215 - DNA, 20 bp, Artificial Sequence
  Description of Artificial Sequence: Synthetic oligonucleotide
  Target: ATXN1; (+) strand; PAM type: YTN; PAM sequence: TTA
atttttaaaatttactcaag

SEQ ID NO: 304216 - DNA, 20 bp, Artificial Sequence
  Description of Artificial Sequence: Synthetic oligonucleotide
  Target: ATXN1; (+) strand; PAM type: YTN; PAM sequence: TTT
ttaaaatttactcaaggtga

SEQ ID NO: 304217 - DNA, 20 bp, Artificial Sequence
  Description of Artificial Sequence: Synthetic oligonucleotide
  Target: ATXN1; (+) strand; PAM type: YTN; PAM sequence: TTT
taaaatttactcaaggtgaa

SEQ ID NO: 304218 - DNA, 20 bp, Artificial Sequence
  Description of Artificial Sequence: Synthetic oligonucleotide
  Target: ATXN1; (+) strand; PAM type: YTN; PAM sequence: TTT
aaaatttactcaaggtgaat

SEQ ID NO: 304219 - DNA, 20 bp, Artificial Sequence
  Description of Artificial Sequence: Synthetic oligonucleotide
  Target: ATXN1; (+) strand; PAM type: YTN; PAM sequence: TTA
aaatttactcaaggtgaatt

SEQ ID NO: 304220 - DNA, 20 bp, Artificial Sequence
  Description of Artificial Sequence: Synthetic oligonucleotide
  Target: ATXN1; (+) strand; PAM type: YTN; PAM sequence: TTT
actcaaggtgaattcttatc

SEQ ID NO: 304221 - DNA, 20 bp, Artificial Sequence
  Description of Artificial Sequence: Synthetic oligonucleotide
  Target: ATXN1; (+) strand; PAM type: YTN; PAM sequence: TTA
ctcaaggtgaattcttatcc

SEQ ID NO: 304222 - DNA, 20 bp, Artificial Sequence
  Description of Artificial Sequence: Synthetic oligonucleotide
  Target: ATXN1; (+) strand; PAM type: YTN; PAM sequence: CTC
aaggtgaattcttatccaga

SEQ ID NO: 304223 - DNA, 20 bp, Artificial Sequence
  Description of Artificial Sequence: Synthetic oligonucleotide
  Target: ATXN1; (+) strand; PAM type: YTN; PAM sequence: TTC
ttatccagatcaattccagg

SEQ ID NO: 304224 - DNA, 20 bp, Artificial Sequence
  Description of Artificial Sequence: Synthetic oligonucleotide
  Target: ATXN1; (+) strand; PAM type: YTN; PAM sequence: CTT
atccagatcaattccaggag

SEQ ID NO: 304225 - DNA, 20 bp, Artificial Sequence
  Description of Artificial Sequence: Synthetic oligonucleotide
  Target: ATXN1; (+) strand; PAM type: YTN; PAM sequence: TTA
tccagatcaattccaggagt

SEQ ID NO: 304226 - DNA, 20 bp, Artificial Sequence
  Description of Artificial Sequence: Synthetic oligonucleotide
  Target: ATXN1; (+) strand; PAM type: YTN; PAM sequence: TTC
caggagttacggggcgtgga

SEQ ID NO: 304227 - DNA, 20 bp, Artificial Sequence
  Description of Artificial Sequence: Synthetic oligonucleotide
  Target: ATXN1; (+) strand; PAM type: YTN; PAM sequence: TTA
cggggcgtggaatttgccag

SEQ ID NO: 304228 - DNA, 20 bp, Artificial Sequence
  Description of Artificial Sequence: Synthetic oligonucleotide
  Target: ATXN1; (+) strand; PAM type: YTN; PAM sequence: TTT
gccagataagccacaccatt

SEQ ID NO: 304229 - DNA, 20 bp, Artificial Sequence
  Description of Artificial Sequence: Synthetic oligonucleotide
  Target: ATXN1; (+) strand; PAM type: YTN; PAM sequence: TTG
ccagataagccacaccattc

SEQ ID NO: 304230 - DNA, 20 bp, Artificial Sequence
  Description of Artificial Sequence: Synthetic oligonucleotide
  Target: ATXN1; (+) strand; PAM type: YTN; PAM sequence: TTC
tatgccatcaagtcacagaa

SEQ ID NO: 304231 - DNA, 20 bp, Artificial Sequence
  Description of Artificial Sequence: Synthetic oligonucleotide
  Target: ATXN1; (+) strand; PAM type: YTN; PAM sequence: CTA
tgccatcaagtcacagaaac

SEQ ID NO: 304232 - DNA, 20 bp, Artificial Sequence
  Description of Artificial Sequence: Synthetic oligonucleotide
  Target: ATXN1; (+) strand; PAM type: YTN; PAM sequence: CTG
gcttccctacactctaattt

SEQ ID NO: 304233 - DNA, 20 bp, Artificial Sequence
  Description of Artificial Sequence: Synthetic oligonucleotide
  Target: ATXN1; (+) strand; PAM type: YTN; PAM sequence: CTT
ccctacactctaatttgtgc

SEQ ID NO: 304234 - DNA, 20 bp, Artificial Sequence
  Description of Artificial Sequence: Synthetic oligonucleotide
  Target: ATXN1; (+) strand; PAM type: YTN; PAM sequence: TTC
cctacactctaatttgtgcc

SEQ ID NO: 304235 - DNA, 20 bp, Artificial Sequence
  Description of Artificial Sequence: Synthetic oligonucleotide
  Target: ATXN1; (+) strand; PAM type: YTN; PAM sequence: CTA
cactctaatttgtgccttgt

SEQ ID NO: 304236 - DNA, 20 bp, Artificial Sequence
  Description of Artificial Sequence: Synthetic oligonucleotide
  Target: ATXN1; (+) strand; PAM type: YTN; PAM sequence: CTC
taatttgtgccttgtctgtt

SEQ ID NO: 304237 - DNA, 20 bp, Artificial Sequence
  Description of Artificial Sequence: Synthetic oligonucleotide
  Target: ATXN1; (+) strand; PAM type: YTN; PAM sequence: CTA
atttgtgccttgtctgttgc

SEQ ID NO: 304238 - DNA, 20 bp, Artificial Sequence
  Description of Artificial Sequence: Synthetic oligonucleotide
  Target: ATXN1; (+) strand; PAM type: YTN; PAM sequence: TTT
gtgccttgtctgttgctttg

SEQ ID NO: 304239 - DNA, 20 bp, Artificial Sequence
  Description of Artificial Sequence: Synthetic oligonucleotide
  Target: ATXN1; (+) strand; PAM type: YTN; PAM sequence: TTG
tgccttgtctgttgctttgg

SEQ ID NO: 304240 - DNA, 20 bp, Artificial Sequence
  Description of Artificial Sequence: Synthetic oligonucleotide
  Target: ATXN1; (+) strand; PAM type: YTN; PAM sequence: CTT
gtctgttgctttgggcatga

SEQ ID NO: 304241 - DNA, 20 bp, Artificial Sequence
  Description of Artificial Sequence: Synthetic oligonucleotide
  Target: ATXN1; (+) strand; PAM type: YTN; PAM sequence: TTG
tctgttgctttgggcatgaa

SEQ ID NO: 304242 - DNA, 20 bp, Artificial Sequence
  Description of Artificial Sequence: Synthetic oligonucleotide
  Target: ATXN1; (+) strand; PAM type: YTN; PAM sequence: CTG
ttgctttgggcatgaaacag

SEQ ID NO: 304243 - DNA, 20 bp, Artificial Sequence
  Description of Artificial Sequence: Synthetic oligonucleotide
  Target: ATXN1; (+) strand; PAM type: YTN; PAM sequence: TTG
ctttgggcatgaaacagaat

SEQ ID NO: 304244 - DNA, 20 bp, Artificial Sequence
  Description of Artificial Sequence: Synthetic oligonucleotide
  Target: ATXN1; (+) strand; PAM type: YTN; PAM sequence: CTT
tgggcatgaaacagaatgtg

SEQ ID NO: 304245 - DNA, 20 bp, Artificial Sequence
  Description of Artificial Sequence: Synthetic oligonucleotide
  Target: ATXN1; (+) strand; PAM type: YTN; PAM sequence: TTT
gggcatgaaacagaatgtgg

SEQ ID NO: 304246 - DNA, 20 bp, Artificial Sequence
  Description of Artificial Sequence: Synthetic oligonucleotide
  Target: ATXN1; (+) strand; PAM type: YTN; PAM sequence: TTG
ggcatgaaacagaatgtggc

SEQ ID NO: 304247 - DNA, 20 bp, Artificial Sequence
  Description of Artificial Sequence: Synthetic oligonucleotide
  Target: ATXN1; (+) strand; PAM type: YTN; PAM sequence: CTT
ctttcatttctcacttcatt

SEQ ID NO: 304248 - DNA, 20 bp, Artificial Sequence
  Description of Artificial Sequence: Synthetic oligonucleotide
  Target: ATXN1; (+) strand; PAM type: YTN; PAM sequence: TTC
tttcatttctcacttcatta

SEQ ID NO: 304249 - DNA, 20 bp, Artificial Sequence
  Description of Artificial Sequence: Synthetic oligonucleotide
  Target: ATXN1; (+) strand; PAM type: YTN; PAM sequence: CTT
tcatttctcacttcattacc

SEQ ID NO: 304250 - DNA, 20 bp, Artificial Sequence
  Description of Artificial Sequence: Synthetic oligonucleotide
  Target: ATXN1; (+) strand; PAM type: YTN; PAM sequence: TTT
catttctcacttcattacct

SEQ ID NO: 304251 - DNA, 20 bp, Artificial Sequence
  Description of Artificial Sequence: Synthetic oligonucleotide
  Target: ATXN1; (+) strand; PAM type: YTN; PAM sequence: TTC
atttctcacttcattaccta

SEQ ID NO: 304252 - DNA, 20 bp, Artificial Sequence
  Description of Artificial Sequence: Synthetic oligonucleotide
  Target: ATXN1; (+) strand; PAM type: YTN; PAM sequence: TTT
ctcacttcattacctaaagt

SEQ ID NO: 304253 - DNA, 20 bp, Artificial Sequence
  Description of Artificial Sequence: Synthetic oligonucleotide
  Target: ATXN1; (+) strand; PAM type: YTN; PAM sequence: TTC
tcacttcattacctaaagtg

SEQ ID NO: 304254 - DNA, 20 bp, Artificial Sequence
  Description of Artificial Sequence: Synthetic oligonucleotide
  Target: ATXN1; (+) strand; PAM type: YTN; PAM sequence: CTC
acttcattacctaaagtgga

SEQ ID NO: 304255 - DNA, 20 bp, Artificial Sequence
  Description of Artificial Sequence: Synthetic oligonucleotide
  Target: ATXN1; (+) strand; PAM type: YTN; PAM sequence: CTT
cattacctaaagtggacata

SEQ ID NO: 304256 - DNA, 20 bp, Artificial Sequence
  Description of Artificial Sequence: Synthetic oligonucleotide
  Target: ATXN1; (+) strand; PAM type: YTN; PAM sequence: TTC
attacctaaagtggacatac

SEQ ID NO: 304257 - DNA, 20 bp, Artificial Sequence
  Description of Artificial Sequence: Synthetic oligonucleotide
  Target: ATXN1; (+) strand; PAM type: YTN; PAM sequence: TTA
cctaaagtggacatacacct

SEQ ID NO: 304258 - DNA, 20 bp, Artificial Sequence
  Description of Artificial Sequence: Synthetic oligonucleotide
  Target: ATXN1; (+) strand; PAM type: YTN; PAM sequence: CTA
aagtggacatacaccttccc

SEQ ID NO: 304259 - DNA, 20 bp, Artificial Sequence
  Description of Artificial Sequence: Synthetic oligonucleotide
  Target: ATXN1; (+) strand; PAM type: YTN; PAM sequence: CTT
cccatactccctctcccctc

SEQ ID NO: 304260 - DNA, 20 bp, Artificial Sequence
  Description of Artificial Sequence: Synthetic oligonucleotide
  Target: ATXN1; (+) strand; PAM type: YTN; PAM sequence: TTC
ccatactccctctcccctct

SEQ ID NO: 304261 - DNA, 20 bp, Artificial Sequence
  Description of Artificial Sequence: Synthetic oligonucleotide
  Target: ATXN1; (+) strand; PAM type: YTN; PAM sequence: CTC
cctctcccctctccttccct

SEQ ID NO: 304262 - DNA, 20 bp, Artificial Sequence
  Description of Artificial Sequence: Synthetic oligonucleotide
  Target: ATXN1; (+) strand; PAM type: YTN; PAM sequence: CTC
tcccctctccttccctaacc

SEQ ID NO: 304263 - DNA, 20 bp, Artificial Sequence
  Description of Artificial Sequence: Synthetic oligonucleotide
  Target: ATXN1; (+) strand; PAM type: YTN; PAM sequence: CTC
ccctctccttccctaaccta

SEQ ID NO: 304264 - DNA, 20 bp, Artificial Sequence
  Description of Artificial Sequence: Synthetic oligonucleotide
  Target: ATXN1; (+) strand; PAM type: YTN; PAM sequence: CTC
tccttccctaacctatcccc

SEQ ID NO: 304265 - DNA, 20 bp, Artificial Sequence
  Description of Artificial Sequence: Synthetic oligonucleotide
  Target: ATXN1; (+) strand; PAM type: YTN; PAM sequence: CTC
cttccctaacctatcccctg

SEQ ID NO: 304266 - DNA, 20 bp, Artificial Sequence
  Description of Artificial Sequence: Synthetic oligonucleotide
  Target: ATXN1; (+) strand; PAM type: YTN; PAM sequence: CTT
ccctaacctatcccctgccc

SEQ ID NO: 304267 - DNA, 20 bp, Artificial Sequence
  Description of Artificial Sequence: Synthetic oligonucleotide
  Target: ATXN1; (+) strand; PAM type: YTN; PAM sequence: TTC
cctaacctatcccctgccca

SEQ ID NO: 304268 - DNA, 20 bp, Artificial Sequence
  Description of Artificial Sequence: Synthetic oligonucleotide
  Target: ATXN1; (+) strand; PAM type: YTN; PAM sequence: CTA
acctatcccctgcccaccct

SEQ ID NO: 304269 - DNA, 20 bp, Artificial Sequence
  Description of Artificial Sequence: Synthetic oligonucleotide
  Target: ATXN1; (+) strand; PAM type: YTN; PAM sequence: CTA
tcccctgcccaccctggccc

SEQ ID NO: 304270 - DNA, 20 bp, Artificial Sequence
  Description of Artificial Sequence: Synthetic oligonucleotide
  Target: ATXN1; (+) strand; PAM type: YTN; PAM sequence: CTG
cccaccctggccccattatt

SEQ ID NO: 304271 - DNA, 20 bp, Artificial Sequence
  Description of Artificial Sequence: Synthetic oligonucleotide
  Target: ATXN1; (+) strand; PAM type: YTN; PAM sequence: CTG
gccccattatttctcacttg

SEQ ID NO: 304272 - DNA, 20 bp, Artificial Sequence
  Description of Artificial Sequence: Synthetic oligonucleotide
  Target: ATXN1; (+) strand; PAM type: YTN; PAM sequence: TTA
tttctcacttggataacagg

SEQ ID NO: 304273 - DNA, 20 bp, Artificial Sequence
  Description of Artificial Sequence: Synthetic oligonucleotide
  Target: ATXN1; (+) strand; PAM type: YTN; PAM sequence: TTT
ctcacttggataacaggaag

SEQ ID NO: 304274 - DNA, 20 bp, Artificial Sequence
  Description of Artificial Sequence: Synthetic oligonucleotide
  Target: ATXN1; (+) strand; PAM type: YTN; PAM sequence: TTC
tcacttggataacaggaagg

SEQ ID NO: 304275 - DNA, 20 bp, Artificial Sequence
  Description of Artificial Sequence: Synthetic oligonucleotide
  Target: ATXN1; (+) strand; PAM type: YTN; PAM sequence: CTC
acttggataacaggaaggtc

SEQ ID NO: 304276 - DNA, 20 bp, Artificial Sequence
  Description of Artificial Sequence: Synthetic oligonucleotide
  Target: ATXN1; (+) strand; PAM type: YTN; PAM sequence: CTT
ggataacaggaaggtcgtac

SEQ ID NO: 304277 - DNA, 20 bp, Artificial Sequence
  Description of Artificial Sequence: Synthetic oligonucleotide
  Target: ATXN1; (+) strand; PAM type: YTN; PAM sequence: TTG
gataacaggaaggtcgtaca

SEQ ID NO: 304278 - DNA, 20 bp, Artificial Sequence
  Description of Artificial Sequence: Synthetic oligonucleotide
  Target: ATXN1; (+) strand; PAM type: YTN; PAM sequence: CTC
tcccttttgaactcatcgtc

SEQ ID NO: 304279 - DNA, 20 bp, Artificial Sequence
  Description of Artificial Sequence: Synthetic oligonucleotide
  Target: ATXN1; (+) strand; PAM type: YTN; PAM sequence: CTC
ccttttgaactcatcgtcca

SEQ ID NO: 304280 - DNA, 20 bp, Artificial Sequence
  Description of Artificial Sequence: Synthetic oligonucleotide
  Target: ATXN1; (+) strand; PAM type: YTN; PAM sequence: CTT
ttgaactcatcgtccacact

SEQ ID NO: 304281 - DNA, 20 bp, Artificial Sequence
  Description of Artificial Sequence: Synthetic oligonucleotide
  Target: ATXN1; (+) strand; PAM type: YTN; PAM sequence: TTT
tgaactcatcgtccacactg

SEQ ID NO: 304282 - DNA, 20 bp, Artificial Sequence
  Description of Artificial Sequence: Synthetic oligonucleotide
  Target: ATXN1; (+) strand; PAM type: YTN; PAM sequence: TTT
gaactcatcgtccacactgg

SEQ ID NO: 304283 - DNA, 20 bp, Artificial Sequence
  Description of Artificial Sequence: Synthetic oligonucleotide
  Target: ATXN1; (+) strand; PAM type: YTN; PAM sequence: TTG
aactcatcgtccacactggg

SEQ ID NO: 304284 - DNA, 20 bp, Artificial Sequence
  Description of Artificial Sequence: Synthetic oligonucleotide
  Target: ATXN1; (+) strand; PAM type: YTN; PAM sequence: CTC
atcgtccacactgggtcaaa

SEQ ID NO: 304285 - DNA, 20 bp, Artificial Sequence
  Description of Artificial Sequence: Synthetic oligonucleotide
  Target: ATXN1; (+) strand; PAM type: YTN; PAM sequence: CTG
ggtcaaatctaaaatacatc

SEQ ID NO: 304286 - DNA, 20 bp, Artificial Sequence
  Description of Artificial Sequence: Synthetic oligonucleotide
  Target: ATXN1; (+) strand; PAM type: YTN; PAM sequence: CTA
aaatacatctgcatatgcca

SEQ ID NO: 304287 - DNA, 20 bp, Artificial Sequence
  Description of Artificial Sequence: Synthetic oligonucleotide
  Target: ATXN1; (+) strand; PAM type: YTN; PAM sequence: CTG
catatgccacatccgctaaa

SEQ ID NO: 304288 - DNA, 20 bp, Artificial Sequence
  Description of Artificial Sequence: Synthetic oligonucleotide
  Target: ATXN1; (+) strand; PAM type: YTN; PAM sequence: CTA
aaaatcattacaatagcttc

SEQ ID NO: 304289 - DNA, 20 bp, Artificial Sequence
  Description of Artificial Sequence: Synthetic oligonucleotide
  Target: ATXN1; (+) strand; PAM type: YTN; PAM sequence: TTA
caatagcttctatttaaaca

SEQ ID NO: 304290 - DNA, 20 bp, Artificial Sequence
  Description of Artificial Sequence: Synthetic oligonucleotide
  Target: ATXN1; (+) strand; PAM type: YTN; PAM sequence: CTT
ctatttaaacatgagtatat

SEQ ID NO: 304291 - DNA, 20 bp, Artificial Sequence
  Description of Artificial Sequence: Synthetic oligonucleotide
  Target: ATXN1; (+) strand; PAM type: YTN; PAM sequence: TTC
tatttaaacatgagtatatc

SEQ ID NO: 304292 - DNA, 20 bp, Artificial Sequence
  Description of Artificial Sequence: Synthetic oligonucleotide
  Target: ATXN1; (+) strand; PAM type: YTN; PAM sequence: CTA
tttaaacatgagtatatccc

SEQ ID NO: 304293 - DNA, 20 bp, Artificial Sequence
  Description of Artificial Sequence: Synthetic oligonucleotide
  Target: ATXN1; (+) strand; PAM type: YTN; PAM sequence: TTT
aaacatgagtatatcccatc

SEQ ID NO: 304294 - DNA, 20 bp, Artificial Sequence
  Description of Artificial Sequence: Synthetic oligonucleotide
  Target: ATXN1; (+) strand; PAM type: YTN; PAM sequence: TTA
aacatgagtatatcccatca

SEQ ID NO: 304295 - DNA, 20 bp, Artificial Sequence
  Description of Artificial Sequence: Synthetic oligonucleotide
  Target: ATXN1; (+) strand; PAM type: YTN; PAM sequence: CTG
gccccatgctacatgcgttc

SEQ ID NO: 304296 - DNA, 20 bp, Artificial Sequence
  Description of Artificial Sequence: Synthetic oligonucleotide
  Target: ATXN1; (+) strand; PAM type: YTN; PAM sequence: CTA
catgcgttcagacattatca

SEQ ID NO: 304297 - DNA, 20 bp, Artificial Sequence
  Description of Artificial Sequence: Synthetic oligonucleotide
  Target: ATXN1; (+) strand; PAM type: YTN; PAM sequence: TTC
agacattatcatatctttat

SEQ ID NO: 304298 - DNA, 20 bp, Artificial Sequence
  Description of Artificial Sequence: Synthetic oligonucleotide
  Target: ATXN1; (+) strand; PAM type: YTN; PAM sequence: TTA
tcatatctttataacaatct

SEQ ID NO: 304299 - DNA, 20 bp, Artificial Sequence
  Description of Artificial Sequence: Synthetic oligonucleotide
  Target: ATXN1; (+) strand; PAM type: YTN; PAM sequence: CTT
tataacaatcttaagagaca

SEQ ID NO: 304300 - DNA, 20 bp, Artificial Sequence
  Description of Artificial Sequence: Synthetic oligonucleotide
  Target: ATXN1; (+) strand; PAM type: YTN; PAM sequence: TTT
ataacaatcttaagagacag

SEQ ID NO: 304301 - DNA, 20 bp, Artificial Sequence
  Description of Artificial Sequence: Synthetic oligonucleotide
  Target: ATXN1; (+) strand; PAM type: YTN; PAM sequence: TTA
taacaatcttaagagacaga

SEQ ID NO: 304302 - DNA, 20 bp, Artificial Sequence
  Description of Artificial Sequence: Synthetic oligonucleotide
  Target: ATXN1; (+) strand; PAM type: YTN; PAM sequence: CTT
aagagacagaggctattatt

SEQ ID NO: 304303 - DNA, 20 bp, Artificial Sequence
  Description of Artificial Sequence: Synthetic oligonucleotide
  Target: ATXN1; (+) strand; PAM type: YTN; PAM sequence: TTA
agagacagaggctattattt

SEQ ID NO: 304304 - DNA, 20 bp, Artificial Sequence
  Description of Artificial Sequence: Synthetic oligonucleotide
  Target: ATXN1; (+) strand; PAM type: YTN; PAM sequence: CTA
ttattttaacgttagagata

SEQ ID NO: 304305 - DNA, 20 bp, Artificial Sequence
  Description of Artificial Sequence: Synthetic oligonucleotide
  Target: ATXN1; (+) strand; PAM type: YTN; PAM sequence: TTA
ttttaacgttagagataaag

SEQ ID NO: 304306 - DNA, 20 bp, Artificial Sequence
  Description of Artificial Sequence: Synthetic oligonucleotide
  Target: ATXN1; (+) strand; PAM type: YTN; PAM sequence: TTT
taacgttagagataaagact

SEQ ID NO: 304307 - DNA, 20 bp, Artificial Sequence
  Description of Artificial Sequence: Synthetic oligonucleotide
  Target: ATXN1; (+) strand; PAM type: YTN; PAM sequence: TTT
aacgttagagataaagactc

SEQ ID NO: 304308 - DNA, 20 bp, Artificial Sequence
  Description of Artificial Sequence: Synthetic oligonucleotide
  Target: ATXN1; (+) strand; PAM type: YTN; PAM sequence: TTA
acgttagagataaagactct

SEQ ID NO: 304309 - DNA, 20 bp, Artificial Sequence
  Description of Artificial Sequence: Synthetic oligonucleotide
  Target: ATXN1; (+) strand; PAM type: YTN; PAM sequence: TTA
gagataaagactcttacagc

SEQ ID NO: 304310 - DNA, 20 bp, Artificial Sequence
  Description of Artificial Sequence: Synthetic oligonucleotide
  Target: ATXN1; (+) strand; PAM type: YTN; PAM sequence: CTC
ttacagctgaggtatgttaa

SEQ ID NO: 304311 - DNA, 20 bp, Artificial Sequence
  Description of Artificial Sequence: Synthetic oligonucleotide
  Target: ATXN1; (+) strand; PAM type: YTN; PAM sequence: CTT
acagctgaggtatgttaaat

SEQ ID NO: 304312 - DNA, 20 bp, Artificial Sequence
  Description of Artificial Sequence: Synthetic oligonucleotide
  Target: ATXN1; (+) strand; PAM type: YTN; PAM sequence: TTA
cagctgaggtatgttaaata

SEQ ID NO: 304313 - DNA, 20 bp, Artificial Sequence
  Description of Artificial Sequence: Synthetic oligonucleotide
  Target: ATXN1; (+) strand; PAM type: YTN; PAM sequence: CTG
aggtatgttaaataacttgc

SEQ ID NO: 304314 - DNA, 20 bp, Artificial Sequence
  Description of Artificial Sequence: Synthetic oligonucleotide
  Target: ATXN1; (+) strand; PAM type: YTN; PAM sequence: TTA
aataacttgctcaaagtcac

SEQ ID NO: 304315 - DNA, 20 bp, Artificial Sequence
  Description of Artificial Sequence: Synthetic oligonucleotide
  Target: ATXN1; (+) strand; PAM type: YTN; PAM sequence: CTT
gctcaaagtcacaaagctag

SEQ ID NO: 304316 - DNA, 20 bp, Artificial Sequence
  Description of Artificial Sequence: Synthetic oligonucleotide
  Target: ATXN1; (+) strand; PAM type: YTN; PAM sequence: TTG
ctcaaagtcacaaagctagt

SEQ ID NO: 304317 - DNA, 20 bp, Artificial Sequence
  Description of Artificial Sequence: Synthetic oligonucleotide
  Target: ATXN1; (+) strand; PAM type: YTN; PAM sequence: CTC
aaagtcacaaagctagtaaa

SEQ ID NO: 304318 - DNA, 20 bp, Artificial Sequence
  Description of Artificial Sequence: Synthetic oligonucleotide
  Target: ATXN1; (+) strand; PAM type: YTN; PAM sequence: CTA
gtaaaatttagggcagctga

SEQ ID NO: 304319 - DNA, 20 bp, Artificial Sequence
  Description of Artificial Sequence: Synthetic oligonucleotide
  Target: ATXN1; (+) strand; PAM type: YTN; PAM sequence: TTT
agggcagctgactctggaac

SEQ ID NO: 304320 - DNA, 20 bp, Artificial Sequence
  Description of Artificial Sequence: Synthetic oligonucleotide
  Target: ATXN1; (+) strand; PAM type: YTN; PAM sequence: TTA
gggcagctgactctggaacc

SEQ ID NO: 304321 - DNA, 20 bp, Artificial Sequence
  Description of Artificial Sequence: Synthetic oligonucleotide
  Target: ATXN1; (+) strand; PAM type: YTN; PAM sequence: CTG
actctggaacctataacatg

SEQ ID NO: 304322 - DNA, 20 bp, Artificial Sequence
  Description of Artificial Sequence: Synthetic oligonucleotide
  Target: ATXN1; (+) strand; PAM type: YTN; PAM sequence: CTC
tggaacctataacatgtgtt

SEQ ID NO: 304323 - DNA, 20 bp, Artificial Sequence
  Description of Artificial Sequence: Synthetic oligonucleotide
  Target: ATXN1; (+) strand; PAM type: YTN; PAM sequence: CTG
gaacctataacatgtgttaa

SEQ ID NO: 304324 - DNA, 20 bp, Artificial Sequence
  Description of Artificial Sequence: Synthetic oligonucleotide
  Target: ATXN1; (+) strand; PAM type: YTN; PAM sequence: CTA
taacatgtgttaattcaaaa

SEQ ID NO: 304325 - DNA, 20 bp, Artificial Sequence
  Description of Artificial Sequence: Synthetic oligonucleotide
  Target: ATXN1; (+) strand; PAM type: YTN; PAM sequence: TTA
attcaaaaaatttcatgact

SEQ ID NO: 304326 - DNA, 20 bp, Artificial Sequence
  Description of Artificial Sequence: Synthetic oligonucleotide
  Target: ATXN1; (+) strand; PAM type: YTN; PAM sequence: TTC
aaaaaatttcatgactactg

SEQ ID NO: 304327 - DNA, 20 bp, Artificial Sequence
  Description of Artificial Sequence: Synthetic oligonucleotide
  Target: ATXN1; (+) strand; PAM type: YTN; PAM sequence: TTT
catgactactgccatcaacg

SEQ ID NO: 304328 - DNA, 20 bp, Artificial Sequence
  Description of Artificial Sequence: Synthetic oligonucleotide
  Target: ATXN1; (+) strand; PAM type: YTN; PAM sequence: TTC
atgactactgccatcaacgg

SEQ ID NO: 304329 - DNA, 20 bp, Artificial Sequence
  Description of Artificial Sequence: Synthetic oligonucleotide
  Target: ATXN1; (+) strand; PAM type: YTN; PAM sequence: CTA
ctgccatcaacggcagtggt

SEQ ID NO: 304330 - DNA, 20 bp, Artificial Sequence
  Description of Artificial Sequence: Synthetic oligonucleotide
  Target: ATXN1; (+) strand; PAM type: YTN; PAM sequence: CTG
ccatcaacggcagtggttcc

SEQ ID NO: 304331 - DNA, 20 bp, Artificial Sequence
  Description of Artificial Sequence: Synthetic oligonucleotide
  Target: ATXN1; (+) strand; PAM type: YTN; PAM sequence: TTC
ccaacattttcttcaatcaa

SEQ ID NO: 304332 - DNA, 20 bp, Artificial Sequence
  Description of Artificial Sequence: Synthetic oligonucleotide
  Target: ATXN1; (+) strand; PAM type: YTN; PAM sequence: TTT
tcttcaatcaaaaatgttgc

SEQ ID NO: 304333 - DNA, 20 bp, Artificial Sequence
  Description of Artificial Sequence: Synthetic oligonucleotide
  Target: ATXN1; (+) strand; PAM type: YTN; PAM sequence: TTT
cttcaatcaaaaatgttgca

SEQ ID NO: 304334 - DNA, 20 bp, Artificial Sequence
  Description of Artificial Sequence: Synthetic oligonucleotide
  Target: ATXN1; (+) strand; PAM type: YTN; PAM sequence: TTC
ttcaatcaaaaatgttgcag

SEQ ID NO: 304335 - DNA, 20 bp, Artificial Sequence
  Description of Artificial Sequence: Synthetic oligonucleotide
  Target: ATXN1; (+) strand; PAM type: YTN; PAM sequence: CTT
caatcaaaaatgttgcagac

SEQ ID NO: 304336 - DNA, 20 bp, Artificial Sequence
  Description of Artificial Sequence: Synthetic oligonucleotide
  Target: ATXN1; (+) strand; PAM type: YTN; PAM sequence: TTC
aatcaaaaatgttgcagact

SEQ ID NO: 304337 - DNA, 20 bp, Artificial Sequence
  Description of Artificial Sequence: Synthetic oligonucleotide
  Target: ATXN1; (+) strand; PAM type: YTN; PAM sequence: TTG
cagacttcaggcactagatg

SEQ ID NO: 304338 - DNA, 20 bp, Artificial Sequence
  Description of Artificial Sequence: Synthetic oligonucleotide
  Target: ATXN1; (+) strand; PAM type: YTN; PAM sequence: CTT
caggcactagatgtttaact

SEQ ID NO: 304339 - DNA, 20 bp, Artificial Sequence
  Description of Artificial Sequence: Synthetic oligonucleotide
  Target: ATXN1; (+) strand; PAM type: YTN; PAM sequence: TTC
aggcactagatgtttaactc

SEQ ID NO: 304340 - DNA, 20 bp, Artificial Sequence
  Description of Artificial Sequence: Synthetic oligonucleotide
  Target: ATXN1; (+) strand; PAM type: YTN; PAM sequence: CTA
gatgtttaactcttaatatc

SEQ ID NO: 304341 - DNA, 20 bp, Artificial Sequence
  Description of Artificial Sequence: Synthetic oligonucleotide
  Target: ATXN1; (+) strand; PAM type: YTN; PAM sequence: TTT
aactcttaatatctgttgat

SEQ ID NO: 304342 - DNA, 20 bp, Artificial Sequence
  Description of Artificial Sequence: Synthetic oligonucleotide
  Target: ATXN1; (+) strand; PAM type: YTN; PAM sequence: TTA
actcttaatatctgttgatc

SEQ ID NO: 304343 - DNA, 20 bp, Artificial Sequence
  Description of Artificial Sequence: Synthetic oligonucleotide
  Target: ATXN1; (+) strand; PAM type: YTN; PAM sequence: CTC
ttaatatctgttgatcaaga

SEQ ID NO: 304344 - DNA, 20 bp, Artificial Sequence
  Description of Artificial Sequence: Synthetic oligonucleotide
  Target: ATXN1; (+) strand; PAM type: YTN; PAM sequence: CTT
aatatctgttgatcaagaag

SEQ ID NO: 304345 - DNA, 20 bp, Artificial Sequence
  Description of Artificial Sequence: Synthetic oligonucleotide
  Target: ATXN1; (+) strand; PAM type: YTN; PAM sequence: TTA
atatctgttgatcaagaaga

SEQ ID NO: 304346 - DNA, 20 bp, Artificial Sequence
  Description of Artificial Sequence: Synthetic oligonucleotide
  Target: ATXN1; (+) strand; PAM type: YTN; PAM sequence: CTG
ttgatcaagaagatgtacaa

SEQ ID NO: 304347 - DNA, 20 bp, Artificial Sequence
  Description of Artificial Sequence: Synthetic oligonucleotide
  Target: ATXN1; (+) strand; PAM type: YTN; PAM sequence: TTG
atcaagaagatgtacaatgg

SEQ ID NO: 304348 - DNA, 20 bp, Artificial Sequence
  Description of Artificial Sequence: Synthetic oligonucleotide
  Target: ATXN1; (+) strand; PAM type: YTN; PAM sequence: CTA
tgaacttagtaacgctgtga

SEQ ID NO: 304349 - DNA, 20 bp, Artificial Sequence
  Description of Artificial Sequence: Synthetic oligonucleotide
  Target: ATXN1; (+) strand; PAM type: YTN; PAM sequence: CTT
agtaacgctgtgaatgaatt

SEQ ID NO: 304350 - DNA, 20 bp, Artificial Sequence
  Description of Artificial Sequence: Synthetic oligonucleotide
  Target: ATXN1; (+) strand; PAM type: YTN; PAM sequence: TTA
gtaacgctgtgaatgaattc

SEQ ID NO: 304351 - DNA, 20 bp, Artificial Sequence
  Description of Artificial Sequence: Synthetic oligonucleotide
  Target: ATXN1; (+) strand; PAM type: YTN; PAM sequence: CTG
tgaatgaattctggctaatg

SEQ ID NO: 304352 - DNA, 20 bp, Artificial Sequence
  Description of Artificial Sequence: Synthetic oligonucleotide
  Target: ATXN1; (+) strand; PAM type: YTN; PAM sequence: TTC
tggctaatgacttacaatat

SEQ ID NO: 304353 - DNA, 20 bp, Artificial Sequence
  Description of Artificial Sequence: Synthetic oligonucleotide
  Target: ATXN1; (+) strand; PAM type: YTN; PAM sequence: CTG
gctaatgacttacaatatca

SEQ ID NO: 304354 - DNA, 20 bp, Artificial Sequence
  Description of Artificial Sequence: Synthetic oligonucleotide
  Target: ATXN1; (+) strand; PAM type: YTN; PAM sequence: CTA
atgacttacaatatcagcca

SEQ ID NO: 304355 - DNA, 20 bp, Artificial Sequence
  Description of Artificial Sequence: Synthetic oligonucleotide
  Target: ATXN1; (+) strand; PAM type: YTN; PAM sequence: CTT
acaatatcagccagctacat

SEQ ID NO: 304356 - DNA, 20 bp, Artificial Sequence
  Description of Artificial Sequence: Synthetic oligonucleotide
  Target: ATXN1; (+) strand; PAM type: YTN; PAM sequence: TTA
caatatcagccagctacata

SEQ ID NO: 304357 - DNA, 20 bp, Artificial Sequence
  Description of Artificial Sequence: Synthetic oligonucleotide
  Target: ATXN1; (+) strand; PAM type: YTN; PAM sequence: CTA
catatatttggaagaaagct

SEQ ID NO: 304358 - DNA, 20 bp, Artificial Sequence
  Description of Artificial Sequence: Synthetic oligonucleotide
  Target: ATXN1; (+) strand; PAM type: YTN; PAM sequence: TTT
ggaagaaagctcctatttct

SEQ ID NO: 304359 - DNA, 20 bp, Artificial Sequence
  Description of Artificial Sequence: Synthetic oligonucleotide
  Target: ATXN1; (+) strand; PAM type: YTN; PAM sequence: TTG
gaagaaagctcctatttctg

SEQ ID NO: 304360 - DNA, 20 bp, Artificial Sequence
  Description of Artificial Sequence: Synthetic oligonucleotide
  Target: ATXN1; (+) strand; PAM type: YTN; PAM sequence: CTC
ctatttctgttagtgattct

SEQ ID NO: 304361 - DNA, 20 bp, Artificial Sequence
  Description of Artificial Sequence: Synthetic oligonucleotide
  Target: ATXN1; (+) strand; PAM type: YTN; PAM sequence: CTA
tttctgttagtgattctgat

SEQ ID NO: 304362 - DNA, 20 bp, Artificial Sequence
  Description of Artificial Sequence: Synthetic oligonucleotide
  Target: ATXN1; (+) strand; PAM type: YTN; PAM sequence: TTT
ctgttagtgattctgatgac

SEQ ID NO: 304363 - DNA, 20 bp, Artificial Sequence
  Description of Artificial Sequence: Synthetic oligonucleotide
  Target: ATXN1; (+) strand; PAM type: YTN; PAM sequence: TTC
tgttagtgattctgatgacc

SEQ ID NO: 304364 - DNA, 20 bp, Artificial Sequence
  Description of Artificial Sequence: Synthetic oligonucleotide
  Target: ATXN1; (+) strand; PAM type: YTN; PAM sequence: CTG
ttagtgattctgatgaccaa

SEQ ID NO: 304365 - DNA, 20 bp, Artificial Sequence
  Description of Artificial Sequence: Synthetic oligonucleotide
  Target: ATXN1; (+) strand; PAM type: YTN; PAM sequence: TTA
gtgattctgatgaccaaatc

SEQ ID NO: 304366 - DNA, 20 bp, Artificial Sequence
  Description of Artificial Sequence: Synthetic oligonucleotide
  Target: ATXN1; (+) strand; PAM type: YTN; PAM sequence: TTC
tgatgaccaaatctacagac

SEQ ID NO: 304367 - DNA, 20 bp, Artificial Sequence
  Description of Artificial Sequence: Synthetic oligonucleotide
  Target: ATXN1; (+) strand; PAM type: YTN; PAM sequence: CTG
atgaccaaatctacagacca

SEQ ID NO: 304368 - DNA, 20 bp, Artificial Sequence
  Description of Artificial Sequence: Synthetic oligonucleotide
  Target: ATXN1; (+) strand; PAM type: YTN; PAM sequence: CTA
cagaccatgctttgtgttgg

SEQ ID NO: 304369 - DNA, 20 bp, Artificial Sequence
  Description of Artificial Sequence: Synthetic oligonucleotide
  Target: ATXN1; (+) strand; PAM type: YTN; PAM sequence: CTT
tgtgttggtatgaatgtgca

SEQ ID NO: 304370 - DNA, 20 bp, Artificial Sequence
  Description of Artificial Sequence: Synthetic oligonucleotide
  Target: ATXN1; (+) strand; PAM type: YTN; PAM sequence: TTT
gtgttggtatgaatgtgcag

SEQ ID NO: 304371 - DNA, 20 bp, Artificial Sequence
  Description of Artificial Sequence: Synthetic oligonucleotide
  Target: ATXN1; (+) strand; PAM type: YTN; PAM sequence: TTG
tgttggtatgaatgtgcagg

SEQ ID NO: 304372 - DNA, 20 bp, Artificial Sequence
  Description of Artificial Sequence: Synthetic oligonucleotide
  Target: ATXN1; (+) strand; PAM type: YTN; PAM sequence: TTG
gtatgaatgtgcaggtcctc

SEQ ID NO: 304373 - DNA, 20 bp, Artificial Sequence
  Description of Artificial Sequence: Synthetic oligonucleotide
  Target: ATXN1; (+) strand; PAM type: YTN; PAM sequence: CTC
ttttacaagaaatgtggtct

SEQ ID NO: 304374 - DNA, 20 bp, Artificial Sequence
  Description of Artificial Sequence: Synthetic oligonucleotide
  Target: ATXN1; (+) strand; PAM type: YTN; PAM sequence: CTT
ttacaagaaatgtggtctcc

SEQ ID NO: 304375 - DNA, 20 bp, Artificial Sequence
  Description of Artificial Sequence: Synthetic oligonucleotide
  Target: ATXN1; (+) strand; PAM type: YTN; PAM sequence: TTT
tacaagaaatgtggtctccc

SEQ ID NO: 304376 - DNA, 20 bp, Artificial Sequence
  Description of Artificial Sequence: Synthetic oligonucleotide
  Target: ATXN1; (+) strand; PAM type: YTN; PAM sequence: TTT
acaagaaatgtggtctccca

SEQ ID NO: 304377 - DNA, 20 bp, Artificial Sequence
  Description of Artificial Sequence: Synthetic oligonucleotide
  Target: ATXN1; (+) strand; PAM type: YTN; PAM sequence: TTA
caagaaatgtggtctcccat

SEQ ID NO: 304378 - DNA, 20 bp, Artificial Sequence
  Description of Artificial Sequence: Synthetic oligonucleotide
  Target: ATXN1; (+) strand; PAM type: YTN; PAM sequence: CTC
ccatatgttttggaatctac

SEQ ID NO: 304379 - DNA, 20 bp, Artificial Sequence
  Description of Artificial Sequence: Synthetic oligonucleotide
  Target: ATXN1; (+) strand; PAM type: YTN; PAM sequence: TTT
tggaatctacagattagaaa

SEQ ID NO: 304380 - DNA, 20 bp, Artificial Sequence
  Description of Artificial Sequence: Synthetic oligonucleotide
  Target: ATXN1; (+) strand; PAM type: YTN; PAM sequence: TTT
ggaatctacagattagaaaa

SEQ ID NO: 304381 - DNA, 20 bp, Artificial Sequence
  Description of Artificial Sequence: Synthetic oligonucleotide
  Target: ATXN1; (+) strand; PAM type: YTN; PAM sequence: TTG
gaatctacagattagaaaac

SEQ ID NO: 304382 - DNA, 20 bp, Artificial Sequence
  Description of Artificial Sequence: Synthetic oligonucleotide
  Target: ATXN1; (+) strand; PAM type: YTN; PAM sequence: CTA
cagattagaaaacccctaga

SEQ ID NO: 304383 - DNA, 20 bp, Artificial Sequence
  Description of Artificial Sequence: Synthetic oligonucleotide
  Target: ATXN1; (+) strand; PAM type: YTN; PAM sequence: TTA
gaaaacccctagaatataag

SEQ ID NO: 304384 - DNA, 20 bp, Artificial Sequence
  Description of Artificial Sequence: Synthetic oligonucleotide
  Target: ATXN1; (+) strand; PAM type: YTN; PAM sequence: CTA
gaatataagccaaagtccat

SEQ ID NO: 304385 - DNA, 20 bp, Artificial Sequence
  Description of Artificial Sequence: Synthetic oligonucleotide
  Target: ATXN1; (+) strand; PAM type: YTN; PAM sequence: CTC
cttagcatttgaaatgccgt

SEQ ID NO: 304386 - DNA, 20 bp, Artificial Sequence
  Description of Artificial Sequence: Synthetic oligonucleotide
  Target: ATXN1; (+) strand; PAM type: YTN; PAM sequence: CTT
agcatttgaaatgccgtaag

SEQ ID NO: 304387 - DNA, 20 bp, Artificial Sequence
  Description of Artificial Sequence: Synthetic oligonucleotide
  Target: ATXN1; (+) strand; PAM type: YTN; PAM sequence: TTA
gcatttgaaatgccgtaagt

SEQ ID NO: 304388 - DNA, 20 bp, Artificial Sequence
  Description of Artificial Sequence: Synthetic oligonucleotide
  Target: ATXN1; (+) strand; PAM type: YTN; PAM sequence: TTT
gaaatgccgtaagtttccca

SEQ ID NO: 304389 - DNA, 20 bp, Artificial Sequence
  Description of Artificial Sequence: Synthetic oligonucleotide
  Target: ATXN1; (+) strand; PAM type: YTN; PAM sequence: TTG
aaatgccgtaagtttcccag

SEQ ID NO: 304390 - DNA, 20 bp, Artificial Sequence
  Description of Artificial Sequence: Synthetic oligonucleotide
  Target: ATXN1; (+) strand; PAM type: YTN; PAM sequence: TTT
cccagtttggctccaactta

SEQ ID NO: 304391 - DNA, 20 bp, Artificial Sequence
  Description of Artificial Sequence: Synthetic oligonucleotide
  Target: ATXN1; (+) strand; PAM type: YTN; PAM sequence: TTC
ccagtttggctccaacttac

SEQ ID NO: 304392 - DNA, 20 bp, Artificial Sequence
  Description of Artificial Sequence: Synthetic oligonucleotide
  Target: ATXN1; (+) strand; PAM type: YTN; PAM sequence: TTT
ggctccaacttacttttcca

SEQ ID NO: 304393 - DNA, 20 bp, Artificial Sequence
  Description of Artificial Sequence: Synthetic oligonucleotide
  Target: ATXN1; (+) strand; PAM type: YTN; PAM sequence: TTG
gctccaacttacttttccaa

SEQ ID NO: 304394 - DNA, 20 bp, Artificial Sequence
  Description of Artificial Sequence: Synthetic oligonucleotide
  Target: ATXN1; (+) strand; PAM type: YTN; PAM sequence: CTC
caacttacttttccaactag

SEQ ID NO: 304395 - DNA, 20 bp, Artificial Sequence
  Description of Artificial Sequence: Synthetic oligonucleotide
  Target: ATXN1; (+) strand; PAM type: YTN; PAM sequence: CTT
acttttccaactagatttcc

SEQ ID NO: 304396 - DNA, 20 bp, Artificial Sequence
  Description of Artificial Sequence: Synthetic oligonucleotide
  Target: ATXN1; (+) strand; PAM type: YTN; PAM sequence: TTA
cttttccaactagatttcct

SEQ ID NO: 304397 - DNA, 20 bp, Artificial Sequence
  Description of Artificial Sequence: Synthetic oligonucleotide
  Target: ATXN1; (+) strand; PAM type: YTN; PAM sequence: CTT
ttccaactagatttcctgta

SEQ ID NO: 304398 - DNA, 20 bp, Artificial Sequence
  Description of Artificial Sequence: Synthetic oligonucleotide
  Target: ATXN1; (+) strand; PAM type: YTN; PAM sequence: TTT
tccaactagatttcctgtaa

SEQ ID NO: 304399 - DNA, 20 bp, Artificial Sequence
  Description of Artificial Sequence: Synthetic oligonucleotide
  Target: ATXN1; (+) strand; PAM type: YTN; PAM sequence: TTT
ccaactagatttcctgtaac

SEQ ID NO: 304400 - DNA, 20 bp, Artificial Sequence
  Description of Artificial Sequence: Synthetic oligonucleotide
  Target: ATXN1; (+) strand; PAM type: YTN; PAM sequence: TTC
caactagatttcctgtaacc

SEQ ID NO: 304401 - DNA, 20 bp, Artificial Sequence
  Description of Artificial Sequence: Synthetic oligonucleotide
  Target: ATXN1; (+) strand; PAM type: YTN; PAM sequence: CTA
gatttcctgtaaccccatac

SEQ ID NO: 304402 - DNA, 20 bp, Artificial Sequence
  Description of Artificial Sequence: Synthetic oligonucleotide
  Target: ATXN1; (+) strand; PAM type: YTN; PAM sequence: TTT
cctgtaaccccataccacgt

SEQ ID NO: 304403 - DNA, 20 bp, Artificial Sequence
  Description of Artificial Sequence: Synthetic oligonucleotide
  Target: ATXN1; (+) strand; PAM type: YTN; PAM sequence: TTC
ctgtaaccccataccacgtc

SEQ ID NO: 304404 - DNA, 20 bp, Artificial Sequence
  Description of Artificial Sequence: Synthetic oligonucleotide
  Target: ATXN1; (+) strand; PAM type: YTN; PAM sequence: CTG
taaccccataccacgtcccc

SEQ ID NO: 304405 - DNA, 20 bp, Artificial Sequence
  Description of Artificial Sequence: Synthetic oligonucleotide
  Target: ATXN1; (+) strand; PAM type: YTN; PAM sequence: CTA
agccctacctctagttgtgt

SEQ ID NO: 304406 - DNA, 20 bp, Artificial Sequence
  Description of Artificial Sequence: Synthetic oligonucleotide
  Target: ATXN1; (+) strand; PAM type: YTN; PAM sequence: CTA
cctctagttgtgttagacaa

SEQ ID NO: 304407 - DNA, 20 bp, Artificial Sequence
  Description of Artificial Sequence: Synthetic oligonucleotide
  Target: ATXN1; (+) strand; PAM type: YTN; PAM sequence: CTC
tagttgtgttagacaagcat

SEQ ID NO: 304408 - DNA, 20 bp, Artificial Sequence
  Description of Artificial Sequence: Synthetic oligonucleotide
  Target: ATXN1; (+) strand; PAM type: YTN; PAM sequence: CTA
gttgtgttagacaagcattc

SEQ ID NO: 304409 - DNA, 20 bp, Artificial Sequence
  Description of Artificial Sequence: Synthetic oligonucleotide
  Target: ATXN1; (+) strand; PAM type: YTN; PAM sequence: TTG
tgttagacaagcattcccaa

SEQ ID NO: 304410 - DNA, 20 bp, Artificial Sequence
  Description of Artificial Sequence: Synthetic oligonucleotide
  Target: ATXN1; (+) strand; PAM type: YTN; PAM sequence: TTA
gacaagcattcccaaattac

SEQ ID NO: 304411 - DNA, 20 bp, Artificial Sequence
  Description of Artificial Sequence: Synthetic oligonucleotide
  Target: ATXN1; (+) strand; PAM type: YTN; PAM sequence: TTC
ccaaattactggataccatg

SEQ ID NO: 304412 - DNA, 20 bp, Artificial Sequence
  Description of Artificial Sequence: Synthetic oligonucleotide
  Target: ATXN1; (+) strand; PAM type: YTN; PAM sequence: TTA
ctggataccatgcacactca

SEQ ID NO: 304413 - DNA, 20 bp, Artificial Sequence
  Description of Artificial Sequence: Synthetic oligonucleotide
  Target: ATXN1; (+) strand; PAM type: YTN; PAM sequence: CTG
gataccatgcacactcaagc

SEQ ID NO: 304414 - DNA, 20 bp, Artificial Sequence
  Description of Artificial Sequence: Synthetic oligonucleotide
  Target: ATXN1; (+) strand; PAM type: YTN; PAM sequence: CTC
aagcctagaggaccacagcc

SEQ ID NO: 304415 - DNA, 20 bp, Artificial Sequence
  Description of Artificial Sequence: Synthetic oligonucleotide
  Target: ATXN1; (+) strand; PAM type: YTN; PAM sequence: CTA
gaggaccacagccatttctg

SEQ ID NO: 304416 - DNA, 20 bp, Artificial Sequence
  Description of Artificial Sequence: Synthetic oligonucleotide
  Target: ATXN1; (+) strand; PAM type: YTN; PAM sequence: TTT
ctgctgcaattctctacctg

SEQ ID NO: 304417 - DNA, 20 bp, Artificial Sequence
  Description of Artificial Sequence: Synthetic oligonucleotide
  Target: ATXN1; (+) strand; PAM type: YTN; PAM sequence: TTC
tgctgcaattctctacctga

SEQ ID NO: 304418 - DNA, 20 bp, Artificial Sequence
  Description of Artificial Sequence: Synthetic oligonucleotide
  Target: ATXN1; (+) strand; PAM type: YTN; PAM sequence: CTG
ctgcaattctctacctgaag

SEQ ID NO: 304419 - DNA, 20 bp, Artificial Sequence
  Description of Artificial Sequence: Synthetic oligonucleotide
  Target: ATXN1; (+) strand; PAM type: YTN; PAM sequence: CTG
caattctctacctgaagaac

SEQ ID NO: 304420 - DNA, 20 bp, Artificial Sequence
  Description of Artificial Sequence: Synthetic oligonucleotide
  Target: ATXN1; (+) strand; PAM type: YTN; PAM sequence: TTC
tctacctgaagaactcaatc

SEQ ID NO: 304421 - DNA, 20 bp, Artificial Sequence
  Description of Artificial Sequence: Synthetic oligonucleotide
  Target: ATXN1; (+) strand; PAM type: YTN; PAM sequence: CTC
tacctgaagaactcaatctc

SEQ ID NO: 304422 - DNA, 20 bp, Artificial Sequence
  Description of Artificial Sequence: Synthetic oligonucleotide
  Target: ATXN1; (+) strand; PAM type: YTN; PAM sequence: CTA
cctgaagaactcaatctcct

SEQ ID NO: 304423 - DNA, 20 bp, Artificial Sequence
  Description of Artificial Sequence: Synthetic oligonucleotide
  Target: ATXN1; (+) strand; PAM type: YTN; PAM sequence: CTG
aagaactcaatctcctttga

SEQ ID NO: 304424 - DNA, 20 bp, Artificial Sequence
  Description of Artificial Sequence: Synthetic oligonucleotide
  Target: ATXN1; (+) strand; PAM type: YTN; PAM sequence: CTC
aatctcctttgagacagagc

SEQ ID NO: 304425 - DNA, 20 bp, Artificial Sequence
  Description of Artificial Sequence: Synthetic oligonucleotide
  Target: ATXN1; (+) strand; PAM type: YTN; PAM sequence: CTC
ctttgagacagagctcaaac

SEQ ID NO: 304426 - DNA, 20 bp, Artificial Sequence
  Description of Artificial Sequence: Synthetic oligonucleotide
  Target: ATXN1; (+) strand; PAM type: YTN; PAM sequence: CTT
tgagacagagctcaaacatc

SEQ ID NO: 304427 - DNA, 20 bp, Artificial Sequence
  Description of Artificial Sequence: Synthetic oligonucleotide
  Target: ATXN1; (+) strand; PAM type: YTN; PAM sequence: TTT
gagacagagctcaaacatct

SEQ ID NO: 304428 - DNA, 20 bp, Artificial Sequence
  Description of Artificial Sequence: Synthetic oligonucleotide
  Target: ATXN1; (+) strand; PAM type: YTN; PAM sequence: TTG
agacagagctcaaacatctc

SEQ ID NO: 304429 - DNA, 20 bp, Artificial Sequence
  Description of Artificial Sequence: Synthetic oligonucleotide
  Target: ATXN1; (+) strand; PAM type: YTN; PAM sequence: CTC
aaacatctccaaccctatgg

SEQ ID NO: 304430 - DNA, 20 bp, Artificial Sequence
  Description of Artificial Sequence: Synthetic oligonucleotide
  Target: ATXN1; (+) strand; PAM type: YTN; PAM sequence: CTC
caaccctatggagccattcc

SEQ ID NO: 304431 - DNA, 20 bp, Artificial Sequence
  Description of Artificial Sequence: Synthetic oligonucleotide
  Target: ATXN1; (+) strand; PAM type: YTN; PAM sequence: CTA
tggagccattcctgacaaca

SEQ ID NO: 304432 - DNA, 20 bp, Artificial Sequence
  Description of Artificial Sequence: Synthetic oligonucleotide
  Target: ATXN1; (+) strand; PAM type: YTN; PAM sequence: TTC
ctgacaacacccccacccac

SEQ ID NO: 304433 - DNA, 20 bp, Artificial Sequence
  Description of Artificial Sequence: Synthetic oligonucleotide
  Target: ATXN1; (+) strand; PAM type: YTN; PAM sequence: CTG
acaacacccccacccactca

SEQ ID NO: 304434 - DNA, 20 bp, Artificial Sequence
  Description of Artificial Sequence: Synthetic oligonucleotide
  Target: ATXN1; (+) strand; PAM type: YTN; PAM sequence: CTC
aaggctaaattaacgcatcc

SEQ ID NO: 304435 - DNA, 20 bp, Artificial Sequence
  Description of Artificial Sequence: Synthetic oligonucleotide
  Target: ATXN1; (+) strand; PAM type: YTN; PAM sequence: CTA
aattaacgcatccttcgtcc

SEQ ID NO: 304436 - DNA, 20 bp, Artificial Sequence
  Description of Artificial Sequence: Synthetic oligonucleotide
  Target: ATXN1; (+) strand; PAM type: YTN; PAM sequence: TTA
acgcatccttcgtccatatg

SEQ ID NO: 304437 - DNA, 20 bp, Artificial Sequence
  Description of Artificial Sequence: Synthetic oligonucleotide
  Target: ATXN1; (+) strand; PAM type: YTN; PAM sequence: CTT
cgtccatatgatcacagtcc

SEQ ID NO: 304438 - DNA, 20 bp, Artificial Sequence
  Description of Artificial Sequence: Synthetic oligonucleotide
  Target: ATXN1; (+) strand; PAM type: YTN; PAM sequence: TTC
gtccatatgatcacagtcct

SEQ ID NO: 304439 - DNA, 20 bp, Artificial Sequence
  Description of Artificial Sequence: Synthetic oligonucleotide
  Target: ATXN1; (+) strand; PAM type: YTN; PAM sequence: CTA
tgatgataagtaacacacta

SEQ ID NO: 304440 - DNA, 20 bp, Artificial Sequence
  Description of Artificial Sequence: Synthetic oligonucleotide
  Target: ATXN1; (+) strand; PAM type: YTN; PAM sequence: CTA
cagataaaatgacatgcatc

SEQ ID NO: 304441 - DNA, 20 bp, Artificial Sequence
  Description of Artificial Sequence: Synthetic oligonucleotide
  Target: ATXN1; (+) strand; PAM type: YTN; PAM sequence: CTC
tgtatctagctatctgacca

SEQ ID NO: 304442 - DNA, 20 bp, Artificial Sequence
  Description of Artificial Sequence: Synthetic oligonucleotide
  Target: ATXN1; (+) strand; PAM type: YTN; PAM sequence: CTG
tatctagctatctgaccact

SEQ ID NO: 304443 - DNA, 20 bp, Artificial Sequence
  Description of Artificial Sequence: Synthetic oligonucleotide
  Target: ATXN1; (+) strand; PAM type: YTN; PAM sequence: CTA
gctatctgaccactcttctc

SEQ ID NO: 304444 - DNA, 20 bp, Artificial Sequence
  Description of Artificial Sequence: Synthetic oligonucleotide
  Target: ATXN1; (+) strand; PAM type: YTN; PAM sequence: CTA
tctgaccactcttctcatcc

SEQ ID NO: 304445 - DNA, 20 bp, Artificial Sequence
  Description of Artificial Sequence: Synthetic oligonucleotide
  Target: ATXN1; (+) strand; PAM type: YTN; PAM sequence: CTG
accactcttctcatccaaac

SEQ ID NO: 304446 - DNA, 20 bp, Artificial Sequence
  Description of Artificial Sequence: Synthetic oligonucleotide
  Target: ATXN1; (+) strand; PAM type: YTN; PAM sequence: CTC
ttctcatccaaacttcccaa

SEQ ID NO: 304447 - DNA, 20 bp, Artificial Sequence
  Description of Artificial Sequence: Synthetic oligonucleotide
  Target: ATXN1; (+) strand; PAM type: YTN; PAM sequence: CTT
ctcatccaaacttcccaagg

SEQ ID NO: 304448 - DNA, 20 bp, Artificial Sequence
  Description of Artificial Sequence: Synthetic oligonucleotide
  Target: ATXN1; (+) strand; PAM type: YTN; PAM sequence: TTC
tcatccaaacttcccaaggg

SEQ ID NO: 304449 - DNA, 20 bp, Artificial Sequence
  Description of Artificial Sequence: Synthetic oligonucleotide
  Target: ATXN1; (+) strand; PAM type: YTN; PAM sequence: CTC
atccaaacttcccaagggca

SEQ ID NO: 304450 - DNA, 20 bp, Artificial Sequence
  Description of Artificial Sequence: Synthetic oligonucleotide
  Target: ATXN1; (+) strand; PAM type: YTN; PAM sequence: CTT
cccaagggcagggattgtgc

SEQ ID NO: 304451 - DNA, 20 bp, Artificial Sequence
  Description of Artificial Sequence: Synthetic oligonucleotide
  Target: ATXN1; (+) strand; PAM type: YTN; PAM sequence: TTC
ccaagggcagggattgtgct

SEQ ID NO: 304452 - DNA, 20 bp, Artificial Sequence
  Description of Artificial Sequence: Synthetic oligonucleotide
  Target: ATXN1; (+) strand; PAM type: YTN; PAM sequence: TTG
tgcttcttcatcagtgtctt

SEQ ID NO: 304453 - DNA, 20 bp, Artificial Sequence
  Description of Artificial Sequence: Synthetic oligonucleotide
  Target: ATXN1; (+) strand; PAM type: YTN; PAM sequence: CTT
cttcatcagtgtcttagccc

SEQ ID NO: 304454 - DNA, 20 bp, Artificial Sequence
  Description of Artificial Sequence: Synthetic oligonucleotide
  Target: ATXN1; (+) strand; PAM type: YTN; PAM sequence: TTC
ttcatcagtgtcttagcccc

SEQ ID NO: 304455 - DNA, 20 bp, Artificial Sequence
  Description of Artificial Sequence: Synthetic oligonucleotide
  Target: ATXN1; (+) strand; PAM type: YTN; PAM sequence: CTT
catcagtgtcttagccccag

SEQ ID NO: 304456 - DNA, 20 bp, Artificial Sequence
  Description of Artificial Sequence: Synthetic oligonucleotide
  Target: ATXN1; (+) strand; PAM type: YTN; PAM sequence: TTC
atcagtgtcttagccccagc

SEQ ID NO: 304457 - DNA, 20 bp, Artificial Sequence
  Description of Artificial Sequence: Synthetic oligonucleotide
  Target: ATXN1; (+) strand; PAM type: YTN; PAM sequence: CTT
agccccagccccatccctga

SEQ ID NO: 304458 - DNA, 20 bp, Artificial Sequence
  Description of Artificial Sequence: Synthetic oligonucleotide
  Target: ATXN1; (+) strand; PAM type: YTN; PAM sequence: TTA
gccccagccccatccctgaa

SEQ ID NO: 304459 - DNA, 20 bp, Artificial Sequence
  Description of Artificial Sequence: Synthetic oligonucleotide
  Target: ATXN1; (+) strand; PAM type: YTN; PAM sequence: CTG
aaatatggtaggtactgttt

SEQ ID NO: 304460 - DNA, 20 bp, Artificial Sequence
  Description of Artificial Sequence: Synthetic oligonucleotide
  Target: ATXN1; (+) strand; PAM type: YTN; PAM sequence: CTG
tttgtaagattaataaatga

SEQ ID NO: 304461 - DNA, 20 bp, Artificial Sequence
  Description of Artificial Sequence: Synthetic oligonucleotide
  Target: ATXN1; (+) strand; PAM type: YTN; PAM sequence: TTT
gtaagattaataaatgagta

SEQ ID NO: 304462 - DNA, 20 bp, Artificial Sequence
  Description of Artificial Sequence: Synthetic oligonucleotide
  Target: ATXN1; (+) strand; PAM type: YTN; PAM sequence: TTG
taagattaataaatgagtat

SEQ ID NO: 304463 - DNA, 20 bp, Artificial Sequence
  Description of Artificial Sequence: Synthetic oligonucleotide
  Target: ATXN1; (+) strand; PAM type: YTN; PAM sequence: TTA
ataaatgagtatcaatgcca

SEQ ID NO: 304464 - DNA, 20 bp, Artificial Sequence
  Description of Artificial Sequence: Synthetic oligonucleotide
  Target: ATXN1; (+) strand; PAM type: YTN; PAM sequence: CTG
gctagtgattttgcctgggg

SEQ ID NO: 304465 - DNA, 20 bp, Artificial Sequence
  Description of Artificial Sequence: Synthetic oligonucleotide
  Target: ATXN1; (+) strand; PAM type: YTN; PAM sequence: CTA
gtgattttgcctggggaagt

SEQ ID NO: 304466 - DNA, 20 bp, Artificial Sequence
  Description of Artificial Sequence: Synthetic oligonucleotide
  Target: ATXN1; (+) strand; PAM type: YTN; PAM sequence: TTT
tgcctggggaagtcagtttg

SEQ ID NO: 304467 - DNA, 20 bp, Artificial Sequence
  Description of Artificial Sequence: Synthetic oligonucleotide
  Target: ATXN1; (+) strand; PAM type: YTN; PAM sequence: TTT
gcctggggaagtcagtttgg

SEQ ID NO: 304468 - DNA, 20 bp, Artificial Sequence
  Description of Artificial Sequence: Synthetic oligonucleotide
  Target: ATXN1; (+) strand; PAM type: YTN; PAM sequence: TTG
cctggggaagtcagtttgga

SEQ ID NO: 304469 - DNA, 20 bp, Artificial Sequence
  Description of Artificial Sequence: Synthetic oligonucleotide
  Target: ATXN1; (+) strand; PAM type: YTN; PAM sequence: CTG
gggaagtcagtttggaaaat

SEQ ID NO: 304470 - DNA, 20 bp, Artificial Sequence
  Description of Artificial Sequence: Synthetic oligonucleotide
  Target: ATXN1; (+) strand; PAM type: YTN; PAM sequence: TTT
ggaaaatagctctgaccact

SEQ ID NO: 304471 - DNA, 20 bp, Artificial Sequence
  Description of Artificial Sequence: Synthetic oligonucleotide
  Target: ATXN1; (+) strand; PAM type: YTN; PAM sequence: TTG
gaaaatagctctgaccacta

SEQ ID NO: 304472 - DNA, 20 bp, Artificial Sequence
  Description of Artificial Sequence: Synthetic oligonucleotide
  Target: ATXN1; (+) strand; PAM type: YTN; PAM sequence: CTC
tgaccactaaagaagctttc

SEQ ID NO: 304473 - DNA, 20 bp, Artificial Sequence
  Description of Artificial Sequence: Synthetic oligonucleotide
  Target: ATXN1; (+) strand; PAM type: YTN; PAM sequence: CTG
accactaaagaagctttctt

SEQ ID NO: 304474 - DNA, 20 bp, Artificial Sequence
  Description of Artificial Sequence: Synthetic oligonucleotide
  Target: ATXN1; (+) strand; PAM type: YTN; PAM sequence: CTA
aagaagctttctttcagtat

SEQ ID NO: 304475 - DNA, 20 bp, Artificial Sequence
  Description of Artificial Sequence: Synthetic oligonucleotide
  Target: ATXN1; (+) strand; PAM type: YTN; PAM sequence: CTT
tctttcagtatgttgtaatg

SEQ ID NO: 304476 - DNA, 20 bp, Artificial Sequence
  Description of Artificial Sequence: Synthetic oligonucleotide
  Target: ATXN1; (+) strand; PAM type: YTN; PAM sequence: TTT
ctttcagtatgttgtaatgg

SEQ ID NO: 304477 - DNA, 20 bp, Artificial Sequence
  Description of Artificial Sequence: Synthetic oligonucleotide
  Target: ATXN1; (+) strand; PAM type: YTN; PAM sequence: TTC
tttcagtatgttgtaatggt

SEQ ID NO: 304478 - DNA, 20 bp, Artificial Sequence
  Description of Artificial Sequence: Synthetic oligonucleotide
  Target: ATXN1; (+) strand; PAM type: YTN; PAM sequence: CTT
tcagtatgttgtaatggtta

SEQ ID NO: 304479 - DNA, 20 bp, Artificial Sequence
  Description of Artificial Sequence: Synthetic oligonucleotide
  Target: ATXN1; (+) strand; PAM type: YTN; PAM sequence: TTT
cagtatgttgtaatggttaa

SEQ ID NO: 304480 - DNA, 20 bp, Artificial Sequence
  Description of Artificial Sequence: Synthetic oligonucleotide
  Target: ATXN1; (+) strand; PAM type: YTN; PAM sequence: TTC
agtatgttgtaatggttaat

SEQ ID NO: 304481 - DNA, 20 bp, Artificial Sequence
  Description of Artificial Sequence: Synthetic oligonucleotide
  Target: ATXN1; (+) strand; PAM type: YTN; PAM sequence: TTG
taatggttaatcatctgtaa

SEQ ID NO: 304482 - DNA, 20 bp, Artificial Sequence
  Description of Artificial Sequence: Synthetic oligonucleotide
  Target: ATXN1; (+) strand; PAM type: YTN; PAM sequence: TTA
atcatctgtaaaccagaaaa

SEQ ID NO: 304483 - DNA, 20 bp, Artificial Sequence
  Description of Artificial Sequence: Synthetic oligonucleotide
  Target: ATXN1; (+) strand; PAM type: YTN; PAM sequence: CTG
taaaccagaaaactcacaac

SEQ ID NO: 304484 - DNA, 20 bp, Artificial Sequence
  Description of Artificial Sequence: Synthetic oligonucleotide
  Target: ATXN1; (+) strand; PAM type: YTN; PAM sequence: CTC
acaacgtcctccaaaagtag

SEQ ID NO: 304485 - DNA, 20 bp, Artificial Sequence
  Description of Artificial Sequence: Synthetic oligonucleotide
  Target: ATXN1; (+) strand; PAM type: YTN; PAM sequence: CTC
caaaagtagaagacaaatac

SEQ ID NO: 304486 - DNA, 20 bp, Artificial Sequence
  Description of Artificial Sequence: Synthetic oligonucleotide
  Target: ATXN1; (+) strand; PAM type: YTN; PAM sequence: CTA
ggaactggaagatctgagct

SEQ ID NO: 304487 - DNA, 20 bp, Artificial Sequence
  Description of Artificial Sequence: Synthetic oligonucleotide
  Target: ATXN1; (+) strand; PAM type: YTN; PAM sequence: CTG
gaagatctgagctcaggtcc

SEQ ID NO: 304488 - DNA, 20 bp, Artificial Sequence
  Description of Artificial Sequence: Synthetic oligonucleotide
  Target: ATXN1; (+) strand; PAM type: YTN; PAM sequence: CTG
agctcaggtcctggctttcc

SEQ ID NO: 304489 - DNA, 20 bp, Artificial Sequence
  Description of Artificial Sequence: Synthetic oligonucleotide
  Target: ATXN1; (+) strand; PAM type: YTN; PAM sequence: CTC
aggtcctggctttcctatga

SEQ ID NO: 304490 - DNA, 20 bp, Artificial Sequence
  Description of Artificial Sequence: Synthetic oligonucleotide
  Target: ATXN1; (+) strand; PAM type: YTN; PAM sequence: CTG
gctttcctatgaaccagctg

SEQ ID NO: 304491 - DNA, 20 bp, Artificial Sequence
  Description of Artificial Sequence: Synthetic oligonucleotide
  Target: ATXN1; (+) strand; PAM type: YTN; PAM sequence: CTT
tcctatgaaccagctgtgtg

SEQ ID NO: 304492 - DNA, 20 bp, Artificial Sequence
  Description of Artificial Sequence: Synthetic oligonucleotide
  Target: ATXN1; (+) strand; PAM type: YTN; PAM sequence: TTT
cctatgaaccagctgtgtga

SEQ ID NO: 304493 - DNA, 20 bp, Artificial Sequence
  Description of Artificial Sequence: Synthetic oligonucleotide
  Target: ATXN1; (+) strand; PAM type: YTN; PAM sequence: TTC
ctatgaaccagctgtgtgac

SEQ ID NO: 304494 - DNA, 20 bp, Artificial Sequence
  Description of Artificial Sequence: Synthetic oligonucleotide
  Target: ATXN1; (+) strand; PAM type: YTN; PAM sequence: CTA
tgaaccagctgtgtgacttt

SEQ ID NO: 304495 - DNA, 20 bp, Artificial Sequence
  Description of Artificial Sequence: Synthetic oligonucleotide
  Target: ATXN1; (+) strand; PAM type: YTN; PAM sequence: CTG
tgtgactttggtcaagtcac

SEQ ID NO: 304496 - DNA, 20 bp, Artificial Sequence
  Description of Artificial Sequence: Synthetic oligonucleotide
  Target: ATXN1; (+) strand; PAM type: YTN; PAM sequence: CTT
tggtcaagtcacattccctc

SEQ ID NO: 304497 - DNA, 20 bp, Artificial Sequence
  Description of Artificial Sequence: Synthetic oligonucleotide
  Target: ATXN1; (+) strand; PAM type: YTN; PAM sequence: TTT
ggtcaagtcacattccctct

SEQ ID NO: 304498 - DNA, 20 bp, Artificial Sequence
  Description of Artificial Sequence: Synthetic oligonucleotide
  Target: ATXN1; (+) strand; PAM type: YTN; PAM sequence: TTG
gtcaagtcacattccctctc

SEQ ID NO: 304499 - DNA, 20 bp, Artificial Sequence
  Description of Artificial Sequence: Synthetic oligonucleotide
  Target: ATXN1; (+) strand; PAM type: YTN; PAM sequence: TTC
cctctctgatcttctgtttg

SEQ ID NO: 304500 - DNA, 20 bp, Artificial Sequence
  Description of Artificial Sequence: Synthetic oligonucleotide
  Target: ATXN1; (+) strand; PAM type: YTN; PAM sequence: CTC
tctgatcttctgtttgttca

SEQ ID NO: 304501 - DNA, 20 bp, Artificial Sequence
  Description of Artificial Sequence: Synthetic oligonucleotide
  Target: ATXN1; (+) strand; PAM type: YTN; PAM sequence: CTC
tgatcttctgtttgttcact

SEQ ID NO: 304502 - DNA, 20 bp, Artificial Sequence
  Description of Artificial Sequence: Synthetic oligonucleotide
  Target: ATXN1; (+) strand; PAM type: YTN; PAM sequence: CTG
atcttctgtttgttcactga

SEQ ID NO: 304503 - DNA, 20 bp, Artificial Sequence
  Description of Artificial Sequence: Synthetic oligonucleotide
  Target: ATXN1; (+) strand; PAM type: YTN; PAM sequence: CTT
ctgtttgttcactgaattgt

SEQ ID NO: 304504 - DNA, 20 bp, Artificial Sequence
  Description of Artificial Sequence: Synthetic oligonucleotide
  Target: ATXN1; (+) strand; PAM type: YTN; PAM sequence: TTC
tgtttgttcactgaattgtg

SEQ ID NO: 304505 - DNA, 20 bp, Artificial Sequence
  Description of Artificial Sequence: Synthetic oligonucleotide
  Target: ATXN1; (+) strand; PAM type: YTN; PAM sequence: CTG
tttgttcactgaattgtggc

SEQ ID NO: 304506 - DNA, 20 bp, Artificial Sequence
  Description of Artificial Sequence: Synthetic oligonucleotide
  Target: ATXN1; (+) strand; PAM type: YTN; PAM sequence: TTT
gttcactgaattgtggcagg

SEQ ID NO: 304507 - DNA, 20 bp, Artificial Sequence
  Description of Artificial Sequence: Synthetic oligonucleotide
  Target: ATXN1; (+) strand; PAM type: YTN; PAM sequence: TTG
ttcactgaattgtggcaggg

SEQ ID NO: 304508 - DNA, 20 bp, Artificial Sequence
  Description of Artificial Sequence: Synthetic oligonucleotide
  Target: ATXN1; (+) strand; PAM type: YTN; PAM sequence: TTC
actgaattgtggcagggttg

SEQ ID NO: 304509 - DNA, 20 bp, Artificial Sequence
  Description of Artificial Sequence: Synthetic oligonucleotide
  Target: ATXN1; (+) strand; PAM type: YTN; PAM sequence: CTG
aattgtggcagggttgtggg

SEQ ID NO: 304510 - DNA, 20 bp, Artificial Sequence
  Description of Artificial Sequence: Synthetic oligonucleotide
  Target: ATXN1; (+) strand; PAM type: YTN; PAM sequence: TTG
tggcagggttgtgggggtgc

SEQ ID NO: 304511 - DNA, 20 bp, Artificial Sequence
  Description of Artificial Sequence: Synthetic oligonucleotide
  Target: ATXN1; (+) strand; PAM type: YTN; PAM sequence: TTG
tgggggtgcaaaaggagggc

SEQ ID NO: 304512 - DNA, 20 bp, Artificial Sequence
  Description of Artificial Sequence: Synthetic oligonucleotide
  Target: ATXN1; (+) strand; PAM type: YTN; PAM sequence: CTT
ctagttcttccctgatgcaa

SEQ ID NO: 304513 - DNA, 20 bp, Artificial Sequence
  Description of Artificial Sequence: Synthetic oligonucleotide
  Target: ATXN1; (+) strand; PAM type: YTN; PAM sequence: TTC
tagttcttccctgatgcaat

SEQ ID NO: 304514 - DNA, 20 bp, Artificial Sequence
  Description of Artificial Sequence: Synthetic oligonucleotide
  Target: ATXN1; (+) strand; PAM type: YTN; PAM sequence: CTA
gttcttccctgatgcaattc

SEQ ID NO: 304515 - DNA, 20 bp, Artificial Sequence
  Description of Artificial Sequence: Synthetic oligonucleotide
  Target: ATXN1; (+) strand; PAM type: YTN; PAM sequence: TTC
ttccctgatgcaattctctg

SEQ ID NO: 304516 - DNA, 20 bp, Artificial Sequence
  Description of Artificial Sequence: Synthetic oligonucleotide
  Target: ATXN1; (+) strand; PAM type: YTN; PAM sequence: CTT
ccctgatgcaattctctgac

SEQ ID NO: 304517 - DNA, 20 bp, Artificial Sequence
  Description of Artificial Sequence: Synthetic oligonucleotide
  Target: ATXN1; (+) strand; PAM type: YTN; PAM sequence: TTC
cctgatgcaattctctgacg

SEQ ID NO: 304518 - DNA, 20 bp, Artificial Sequence
  Description of Artificial Sequence: Synthetic oligonucleotide
  Target: ATXN1; (+) strand; PAM type: YTN; PAM sequence: CTG
atgcaattctctgacgtgca

SEQ ID NO: 304519 - DNA, 20 bp, Artificial Sequence
  Description of Artificial Sequence: Synthetic oligonucleotide
  Target: ATXN1; (+) strand; PAM type: YTN; PAM sequence: TTC
tctgacgtgcaaaggtatag

SEQ ID NO: 304520 - DNA, 20 bp, Artificial Sequence
  Description of Artificial Sequence: Synthetic oligonucleotide
  Target: ATXN1; (+) strand; PAM type: YTN; PAM sequence: CTC
tgacgtgcaaaggtatagac

SEQ ID NO: 304521 - DNA, 20 bp, Artificial Sequence
  Description of Artificial Sequence: Synthetic oligonucleotide
  Target: ATXN1; (+) strand; PAM type: YTN; PAM sequence: CTG
acgtgcaaaggtatagacta

SEQ ID NO: 304522 - DNA, 20 bp, Artificial Sequence
  Description of Artificial Sequence: Synthetic oligonucleotide
  Target: ATXN1; (+) strand; PAM type: YTN; PAM sequence: CTA
cagttggcaaacattttctg

SEQ ID NO: 304523 - DNA, 20 bp, Artificial Sequence
  Description of Artificial Sequence: Synthetic oligonucleotide
  Target: ATXN1; (+) strand; PAM type: YTN; PAM sequence: TTG
gcaaacattttctgatgagg

SEQ ID NO: 304524 - DNA, 20 bp, Artificial Sequence
  Description of Artificial Sequence: Synthetic oligonucleotide
  Target: ATXN1; (+) strand; PAM type: YTN; PAM sequence: TTT
tctgatgaggatcagatagt

SEQ ID NO: 304525 - DNA, 20 bp, Artificial Sequence
  Description of Artificial Sequence: Synthetic oligonucleotide
  Target: ATXN1; (+) strand; PAM type: YTN; PAM sequence: TTT
ctgatgaggatcagatagta

SEQ ID NO: 304526 - DNA, 20 bp, Artificial Sequence
  Description of Artificial Sequence: Synthetic oligonucleotide
  Target: ATXN1; (+) strand; PAM type: YTN; PAM sequence: TTC
tgatgaggatcagatagtag

SEQ ID NO: 304527 - DNA, 20 bp, Artificial Sequence
  Description of Artificial Sequence: Synthetic oligonucleotide
  Target: ATXN1; (+) strand; PAM type: YTN; PAM sequence: CTG
atgaggatcagatagtagat

SEQ ID NO: 304528 - DNA, 20 bp, Artificial Sequence
  Description of Artificial Sequence: Synthetic oligonucleotide
  Target: ATXN1; (+) strand; PAM type: YTN; PAM sequence: TTT
caggctttcttggactatgg

SEQ ID NO: 304529 - DNA, 20 bp, Artificial Sequence
  Description of Artificial Sequence: Synthetic oligonucleotide
  Target: ATXN1; (+) strand; PAM type: YTN; PAM sequence: TTC
aggctttcttggactatggt

SEQ ID NO: 304530 - DNA, 20 bp, Artificial Sequence
  Description of Artificial Sequence: Synthetic oligonucleotide
  Target: ATXN1; (+) strand; PAM type: YTN; PAM sequence: CTT
tcttggactatggtctcttt

SEQ ID NO: 304531 - DNA, 20 bp, Artificial Sequence
  Description of Artificial Sequence: Synthetic oligonucleotide
  Target: ATXN1; (+) strand; PAM type: YTN; PAM sequence: TTT
cttggactatggtctctttc

SEQ ID NO: 304532 - DNA, 20 bp, Artificial Sequence
  Description of Artificial Sequence: Synthetic oligonucleotide
  Target: ATXN1; (+) strand; PAM type: YTN; PAM sequence: TTC
ttggactatggtctctttca

SEQ ID NO: 304533 - DNA, 20 bp, Artificial Sequence
  Description of Artificial Sequence: Synthetic oligonucleotide
  Target: ATXN1; (+) strand; PAM type: YTN; PAM sequence: CTT
ggactatggtctctttcacc

SEQ ID NO: 304534 - DNA, 20 bp, Artificial Sequence
  Description of Artificial Sequence: Synthetic oligonucleotide
  Target: ATXN1; (+) strand; PAM type: YTN; PAM sequence: TTG
gactatggtctctttcacca

SEQ ID NO: 304535 - DNA, 20 bp, Artificial Sequence
  Description of Artificial Sequence: Synthetic oligonucleotide
  Target: ATXN1; (+) strand; PAM type: YTN; PAM sequence: CTA
tggtctctttcaccatgact

SEQ ID NO: 304536 - DNA, 20 bp, Artificial Sequence
  Description of Artificial Sequence: Synthetic oligonucleotide
  Target: ATXN1; (+) strand; PAM type: YTN; PAM sequence: CTC
tttcaccatgactcaaatca

SEQ ID NO: 304537 - DNA, 20 bp, Artificial Sequence
  Description of Artificial Sequence: Synthetic oligonucleotide
  Target: ATXN1; (+) strand; PAM type: YTN; PAM sequence: CTT
tcaccatgactcaaatcaaa

SEQ ID NO: 304538 - DNA, 20 bp, Artificial Sequence
  Description of Artificial Sequence: Synthetic oligonucleotide
  Target: ATXN1; (+) strand; PAM type: YTN; PAM sequence: TTT
caccatgactcaaatcaaat

SEQ ID NO: 304539 - DNA, 20 bp, Artificial Sequence
  Description of Artificial Sequence: Synthetic oligonucleotide
  Target: ATXN1; (+) strand; PAM type: YTN; PAM sequence: TTC
accatgactcaaatcaaatt

SEQ ID NO: 304540 - DNA, 20 bp, Artificial Sequence
  Description of Artificial Sequence: Synthetic oligonucleotide
  Target: ATXN1; (+) strand; PAM type: YTN; PAM sequence: CTC
aaatcaaattctgccagtgt

SEQ ID NO: 304541 - DNA, 20 bp, Artificial Sequence
  Description of Artificial Sequence: Synthetic oligonucleotide
  Target: ATXN1; (+) strand; PAM type: YTN; PAM sequence: TTC
tgccagtgtagtgcaaaaac

SEQ ID NO: 304542 - DNA, 20 bp, Artificial Sequence
  Description of Artificial Sequence: Synthetic oligonucleotide
  Target: ATXN1; (+) strand; PAM type: YTN; PAM sequence: CTG
ccagtgtagtgcaaaaactg

SEQ ID NO: 304543 - DNA, 20 bp, Artificial Sequence
  Description of Artificial Sequence: Synthetic oligonucleotide
  Target: ATXN1; (+) strand; PAM type: YTN; PAM sequence: CTG
ctatagacattagacaaatt

SEQ ID NO: 304544 - DNA, 20 bp, Artificial Sequence
  Description of Artificial Sequence: Synthetic oligonucleotide
  Target: ATXN1; (+) strand; PAM type: YTN; PAM sequence: CTA
tagacattagacaaattatt

SEQ ID NO: 304545 - DNA, 20 bp, Artificial Sequence
  Description of Artificial Sequence: Synthetic oligonucleotide
  Target: ATXN1; (+) strand; PAM type: YTN; PAM sequence: TTA
gacaaattattggatgtagc

SEQ ID NO: 304546 - DNA, 20 bp, Artificial Sequence
  Description of Artificial Sequence: Synthetic oligonucleotide
  Target: ATXN1; (+) strand; PAM type: YTN; PAM sequence: TTA
ttggatgtagctatgtgcta

SEQ ID NO: 304547 - DNA, 20 bp, Artificial Sequence
  Description of Artificial Sequence: Synthetic oligonucleotide
  Target: ATXN1; (+) strand; PAM type: YTN; PAM sequence: TTG
gatgtagctatgtgctaata

SEQ ID NO: 304548 - DNA, 20 bp, Artificial Sequence
  Description of Artificial Sequence: Synthetic oligonucleotide
  Target: ATXN1; (+) strand; PAM type: YTN; PAM sequence: CTA
tgtgctaataaaactttatt

SEQ ID NO: 304549 - DNA, 20 bp, Artificial Sequence
  Description of Artificial Sequence: Synthetic oligonucleotide
  Target: ATXN1; (+) strand; PAM type: YTN; PAM sequence: CTA
ataaaactttatttacaaga

SEQ ID NO: 304550 - DNA, 20 bp, Artificial Sequence
  Description of Artificial Sequence: Synthetic oligonucleotide
  Target: ATXN1; (+) strand; PAM type: YTN; PAM sequence: CTT
tatttacaagaacaggctgg

SEQ ID NO: 304551 - DNA, 20 bp, Artificial Sequence
  Description of Artificial Sequence: Synthetic oligonucleotide
  Target: ATXN1; (+) strand; PAM type: YTN; PAM sequence: TTT
atttacaagaacaggctgga

SEQ ID NO: 304552 - DNA, 20 bp, Artificial Sequence
  Description of Artificial Sequence: Synthetic oligonucleotide
  Target: ATXN1; (+) strand; PAM type: YTN; PAM sequence: TTA
tttacaagaacaggctggat

SEQ ID NO: 304553 - DNA, 20 bp, Artificial Sequence
  Description of Artificial Sequence: Synthetic oligonucleotide
  Target: ATXN1; (+) strand; PAM type: YTN; PAM sequence: TTT
acaagaacaggctggatttg

SEQ ID NO: 304554 - DNA, 20 bp, Artificial Sequence
  Description of Artificial Sequence: Synthetic oligonucleotide
  Target: ATXN1; (+) strand; PAM type: YTN; PAM sequence: TTA
caagaacaggctggatttgg

SEQ ID NO: 304555 - DNA, 20 bp, Artificial Sequence
  Description of Artificial Sequence: Synthetic oligonucleotide
  Target: ATXN1; (+) strand; PAM type: YTN; PAM sequence: CTG
gatttggcccatggaccata

SEQ ID NO: 304556 - DNA, 20 bp, Artificial Sequence
  Description of Artificial Sequence: Synthetic oligonucleotide
  Target: ATXN1; (+) strand; PAM type: YTN; PAM sequence: TTT
ggcccatggaccatagtttg

SEQ ID NO: 304557 - DNA, 20 bp, Artificial Sequence
  Description of Artificial Sequence: Synthetic oligonucleotide
  Target: ATXN1; (+) strand; PAM type: YTN; PAM sequence: TTG
gcccatggaccatagtttgc

SEQ ID NO: 304558 - DNA, 20 bp, Artificial Sequence
  Description of Artificial Sequence: Synthetic oligonucleotide
  Target: ATXN1; (+) strand; PAM type: YTN; PAM sequence: TTT
gcctactcctggtctggatg

SEQ ID NO: 304559 - DNA, 20 bp, Artificial Sequence
  Description of Artificial Sequence: Synthetic oligonucleotide
  Target: ATXN1; (+) strand; PAM type: YTN; PAM sequence: TTG
cctactcctggtctggatga

SEQ ID NO: 304560 - DNA, 20 bp, Artificial Sequence
  Description of Artificial Sequence: Synthetic oligonucleotide
  Target: ATXN1; (+) strand; PAM type: YTN; PAM sequence: CTA
ctcctggtctggatgaatgc

SEQ ID NO: 304561 - DNA, 20 bp, Artificial Sequence
  Description of Artificial Sequence: Synthetic oligonucleotide
  Target: ATXN1; (+) strand; PAM type: YTN; PAM sequence: CTC
ctggtctggatgaatgcctc

SEQ ID NO: 304562 - DNA, 20 bp, Artificial Sequence
  Description of Artificial Sequence: Synthetic oligonucleotide
  Target: ATXN1; (+) strand; PAM type: YTN; PAM sequence: CTG
gtctggatgaatgcctcctt

SEQ ID NO: 304563 - DNA, 20 bp, Artificial Sequence
  Description of Artificial Sequence: Synthetic oligonucleotide
  Target: ATXN1; (+) strand; PAM type: YTN; PAM sequence: CTG
gatgaatgcctccttgttgc

SEQ ID NO: 304564 - DNA, 20 bp, Artificial Sequence
  Description of Artificial Sequence: Synthetic oligonucleotide
  Target: ATXN1; (+) strand; PAM type: YTN; PAM sequence: CTC
cttgttgccattcagttcac

SEQ ID NO: 304565 - DNA, 20 bp, Artificial Sequence
  Description of Artificial Sequence: Synthetic oligonucleotide
  Target: ATXN1; (+) strand; PAM type: YTN; PAM sequence: CTT
gttgccattcagttcacaga

SEQ ID NO: 304566 - DNA, 20 bp, Artificial Sequence
  Description of Artificial Sequence: Synthetic oligonucleotide
  Target: ATXN1; (+) strand; PAM type: YTN; PAM sequence: TTG
ttgccattcagttcacagag

SEQ ID NO: 304567 - DNA, 20 bp, Artificial Sequence
  Description of Artificial Sequence: Synthetic oligonucleotide
  Target: ATXN1; (+) strand; PAM type: YTN; PAM sequence: TTG
ccattcagttcacagagctt

SEQ ID NO: 304568 - DNA, 20 bp, Artificial Sequence
  Description of Artificial Sequence: Synthetic oligonucleotide
  Target: ATXN1; (+) strand; PAM type: YTN; PAM sequence: TTC
agttcacagagcttgatatg

SEQ ID NO: 304569 - DNA, 20 bp, Artificial Sequence
  Description of Artificial Sequence: Synthetic oligonucleotide
  Target: ATXN1; (+) strand; PAM type: YTN; PAM sequence: TTC
acagagcttgatatgaagat

SEQ ID NO: 304570 - DNA, 20 bp, Artificial Sequence
  Description of Artificial Sequence: Synthetic oligonucleotide
  Target: ATXN1; (+) strand; PAM type: YTN; PAM sequence: CTT
gatatgaagatacagttcac

SEQ ID NO: 304571 - DNA, 20 bp, Artificial Sequence
  Description of Artificial Sequence: Synthetic oligonucleotide
  Target: ATXN1; (+) strand; PAM type: YTN; PAM sequence: TTG
atatgaagatacagttcacg

SEQ ID NO: 304572 - DNA, 20 bp, Artificial Sequence
  Description of Artificial Sequence: Synthetic oligonucleotide
  Target: ATXN1; (+) strand; PAM type: YTN; PAM sequence: TTC
acgagatgtccatcccaaag

SEQ ID NO: 304573 - DNA, 20 bp, Artificial Sequence
  Description of Artificial Sequence: Synthetic oligonucleotide
  Target: ATXN1; (+) strand; PAM type: YTN; PAM sequence: CTC
tatccattccaaagggactt

SEQ ID NO: 304574 - DNA, 20 bp, Artificial Sequence
  Description of Artificial Sequence: Synthetic oligonucleotide
  Target: ATXN1; (+) strand; PAM type: YTN; PAM sequence: CTA
tccattccaaagggacttat

SEQ ID NO: 304575 - DNA, 20 bp, Artificial Sequence
  Description of Artificial Sequence: Synthetic oligonucleotide
  Target: ATXN1; (+) strand; PAM type: YTN; PAM sequence: TTC
caaagggacttataagaagg

SEQ ID NO: 304576 - DNA, 20 bp, Artificial Sequence
  Description of Artificial Sequence: Synthetic oligonucleotide
  Target: ATXN1; (+) strand; PAM type: YTN; PAM sequence: CTT
ataagaaggacaataaagat

SEQ ID NO: 304577 - DNA, 20 bp, Artificial Sequence
  Description of Artificial Sequence: Synthetic oligonucleotide
  Target: ATXN1; (+) strand; PAM type: YTN; PAM sequence: TTA
taagaaggacaataaagatt

SEQ ID NO: 304578 - DNA, 20 bp, Artificial Sequence
  Description of Artificial Sequence: Synthetic oligonucleotide
  Target: ATXN1; (+) strand; PAM type: YTN; PAM sequence: TTA
ccattccccaaccaagaact

SEQ ID NO: 304579 - DNA, 20 bp, Artificial Sequence
  Description of Artificial Sequence: Synthetic oligonucleotide
  Target: ATXN1; (+) strand; PAM type: YTN; PAM sequence: TTC
cccaaccaagaacttgacaa

SEQ ID NO: 304580 - DNA, 20 bp, Artificial Sequence
  Description of Artificial Sequence: Synthetic oligonucleotide
  Target: ATXN1; (+) strand; PAM type: YTN; PAM sequence: CTT
gacaacggggaagagattgc

SEQ ID NO: 304581 - DNA, 20 bp, Artificial Sequence
  Description of Artificial Sequence: Synthetic oligonucleotide
  Target: ATXN1; (+) strand; PAM type: YTN; PAM sequence: TTG
acaacggggaagagattgcc

SEQ ID NO: 304582 - DNA, 20 bp, Artificial Sequence
  Description of Artificial Sequence: Synthetic oligonucleotide
  Target: ATXN1; (+) strand; PAM type: YTN; PAM sequence: TTG
cctagttagcggtttatagt

SEQ ID NO: 304583 - DNA, 20 bp, Artificial Sequence
  Description of Artificial Sequence: Synthetic oligonucleotide
  Target: ATXN1; (+) strand; PAM type: YTN; PAM sequence: CTA
gttagcggtttatagtaaga

SEQ ID NO: 304584 - DNA, 20 bp, Artificial Sequence
  Description of Artificial Sequence: Synthetic oligonucleotide
  Target: ATXN1; (+) strand; PAM type: YTN; PAM sequence: TTA
gcggtttatagtaagaacaa

SEQ ID NO: 304585 - DNA, 20 bp, Artificial Sequence
  Description of Artificial Sequence: Synthetic oligonucleotide
  Target: ATXN1; (+) strand; PAM type: YTN; PAM sequence: TTT
atagtaagaacaaaatttag

SEQ ID NO: 304586 - DNA, 20 bp, Artificial Sequence
  Description of Artificial Sequence: Synthetic oligonucleotide
  Target: ATXN1; (+) strand; PAM type: YTN; PAM sequence: TTA
tagtaagaacaaaatttagt

SEQ ID NO: 304587 - DNA, 20 bp, Artificial Sequence
  Description of Artificial Sequence: Synthetic oligonucleotide
  Target: ATXN1; (+) strand; PAM type: YTN; PAM sequence: TTT
agtggatgagaacatggaca

SEQ ID NO: 304588 - DNA, 20 bp, Artificial Sequence
  Description of Artificial Sequence: Synthetic oligonucleotide
  Target: ATXN1; (+) strand; PAM type: YTN; PAM sequence: TTA
gtggatgagaacatggacat

SEQ ID NO: 304589 - DNA, 20 bp, Artificial Sequence
  Description of Artificial Sequence: Synthetic oligonucleotide
  Target: ATXN1; (+) strand; PAM type: YTN; PAM sequence: CTG
aagaaagataattactacca

SEQ ID NO: 304590 - DNA, 20 bp, Artificial Sequence
  Description of Artificial Sequence: Synthetic oligonucleotide
  Target: ATXN1; (+) strand; PAM type: YTN; PAM sequence: TTA
ctaccatcaccactacccct

SEQ ID NO: 304591 - DNA, 20 bp, Artificial Sequence
  Description of Artificial Sequence: Synthetic oligonucleotide
  Target: ATXN1; (+) strand; PAM type: YTN; PAM sequence: CTA
ccatcaccactacccctgcc

SEQ ID NO: 304592 - DNA, 20 bp, Artificial Sequence
  Description of Artificial Sequence: Synthetic oligonucleotide
  Target: ATXN1; (+) strand; PAM type: YTN; PAM sequence: CTA
cccctgccccagccagcacc

SEQ ID NO: 304593 - DNA, 20 bp, Artificial Sequence
  Description of Artificial Sequence: Synthetic oligonucleotide
  Target: ATXN1; (+) strand; PAM type: YTN; PAM sequence: CTG
ccccagccagcacctgatga

SEQ ID NO: 304594 - DNA, 20 bp, Artificial Sequence
  Description of Artificial Sequence: Synthetic oligonucleotide
  Target: ATXN1; (+) strand; PAM type: YTN; PAM sequence: CTG
atgaaatatagtcatgaatt

SEQ ID NO: 304595 - DNA, 20 bp, Artificial Sequence
  Description of Artificial Sequence: Synthetic oligonucleotide
  Target: ATXN1; (+) strand; PAM type: YTN; PAM sequence: TTT
aagaaaagactgtgtcctca

SEQ ID NO: 304596 - DNA, 20 bp, Artificial Sequence
  Description of Artificial Sequence: Synthetic oligonucleotide
  Target: ATXN1; (+) strand; PAM type: YTN; PAM sequence: TTA
agaaaagactgtgtcctcaa

SEQ ID NO: 304597 - DNA, 20 bp, Artificial Sequence
  Description of Artificial Sequence: Synthetic oligonucleotide
  Target: ATXN1; (+) strand; PAM type: YTN; PAM sequence: CTG
tgtcctcaaaagggcgccag

SEQ ID NO: 304598 - DNA, 20 bp, Artificial Sequence
  Description of Artificial Sequence: Synthetic oligonucleotide
  Target: ATXN1; (+) strand; PAM type: YTN; PAM sequence: CTC
aaaagggcgccagggctggc

SEQ ID NO: 304599 - DNA, 20 bp, Artificial Sequence
  Description of Artificial Sequence: Synthetic oligonucleotide
  Target: ATXN1; (+) strand; PAM type: YTN; PAM sequence: CTG
gcttagccaggaaagtacag

SEQ ID NO: 304600 - DNA, 20 bp, Artificial Sequence
  Description of Artificial Sequence: Synthetic oligonucleotide
  Target: ATXN1; (+) strand; PAM type: YTN; PAM sequence: CTT
agccaggaaagtacagagtc

SEQ ID NO: 304601 - DNA, 20 bp, Artificial Sequence
  Description of Artificial Sequence: Synthetic oligonucleotide
  Target: ATXN1; (+) strand; PAM type: YTN; PAM sequence: TTA
gccaggaaagtacagagtca

SEQ ID NO: 304602 - DNA, 20 bp, Artificial Sequence
  Description of Artificial Sequence: Synthetic oligonucleotide
  Target: ATXN1; (+) strand; PAM type: YTN; PAM sequence: CTA
aagtctatgtaggcaatgcc

SEQ ID NO: 304603 - DNA, 20 bp, Artificial Sequence
  Description of Artificial Sequence: Synthetic oligonucleotide
  Target: ATXN1; (+) strand; PAM type: YTN; PAM sequence: CTA
tgtaggcaatgccaaggttg

SEQ ID NO: 304604 - DNA, 20 bp, Artificial Sequence
  Description of Artificial Sequence: Synthetic oligonucleotide
  Target: ATXN1; (+) strand; PAM type: YTN; PAM sequence: TTG
ttggggagaatacagtgtct

SEQ ID NO: 304605 - DNA, 20 bp, Artificial Sequence
  Description of Artificial Sequence: Synthetic oligonucleotide
  Target: ATXN1; (+) strand; PAM type: YTN; PAM sequence: TTG
gggagaatacagtgtcttca

SEQ ID NO: 304606 - DNA, 20 bp, Artificial Sequence
  Description of Artificial Sequence: Synthetic oligonucleotide
  Target: ATXN1; (+) strand; PAM type: YTN; PAM sequence: CTT
cacaggcaaggccaccctag

SEQ ID NO: 304607 - DNA, 20 bp, Artificial Sequence
  Description of Artificial Sequence: Synthetic oligonucleotide
  Target: ATXN1; (+) strand; PAM type: YTN; PAM sequence: TTC
acaggcaaggccaccctagt

SEQ ID NO: 304608 - DNA, 20 bp, Artificial Sequence
  Description of Artificial Sequence: Synthetic oligonucleotide
  Target: ATXN1; (+) strand; PAM type: YTN; PAM sequence: CTA
gtgagatgactgtagggagt

SEQ ID NO: 304609 - DNA, 20 bp, Artificial Sequence
  Description of Artificial Sequence: Synthetic oligonucleotide
  Target: ATXN1; (+) strand; PAM type: YTN; PAM sequence: CTG
tagggagtagcaggcaatga

SEQ ID NO: 304610 - DNA, 20 bp, Artificial Sequence
  Description of Artificial Sequence: Synthetic oligonucleotide
  Target: ATXN1; (+) strand; PAM type: YTN; PAM sequence: CTG
acatgttcctggtcccacta

SEQ ID NO: 304611 - DNA, 20 bp, Artificial Sequence
  Description of Artificial Sequence: Synthetic oligonucleotide
  Target: ATXN1; (+) strand; PAM type: YTN; PAM sequence: TTC
ctggtcccactagaaaagcc

SEQ ID NO: 304612 - DNA, 20 bp, Artificial Sequence
  Description of Artificial Sequence: Synthetic oligonucleotide
  Target: ATXN1; (+) strand; PAM type: YTN; PAM sequence: CTG
gtcccactagaaaagccacc

SEQ ID NO: 304613 - DNA, 20 bp, Artificial Sequence
  Description of Artificial Sequence: Synthetic oligonucleotide
  Target: ATXN1; (+) strand; PAM type: YTN; PAM sequence: CTA
gaaaagccacccttctcctg

SEQ ID NO: 304614 - DNA, 20 bp, Artificial Sequence
  Description of Artificial Sequence: Synthetic oligonucleotide
  Target: ATXN1; (+) strand; PAM type: YTN; PAM sequence: CTT
ctcctgagatgaacagagag

SEQ ID NO: 304615 - DNA, 20 bp, Artificial Sequence
  Description of Artificial Sequence: Synthetic oligonucleotide
  Target: ATXN1; (+) strand; PAM type: YTN; PAM sequence: TTC
tcctgagatgaacagagagg

SEQ ID NO: 304616 - DNA, 20 bp, Artificial Sequence
  Description of Artificial Sequence: Synthetic oligonucleotide
  Target: ATXN1; (+) strand; PAM type: YTN; PAM sequence: CTC
ctgagatgaacagagaggca

SEQ ID NO: 304617 - DNA, 20 bp, Artificial Sequence
  Description of Artificial Sequence: Synthetic oligonucleotide
  Target: ATXN1; (+) strand; PAM type: YTN; PAM sequence: CTG
agatgaacagagaggcaggc

SEQ ID NO: 304618 - DNA, 20 bp, Artificial Sequence
  Description of Artificial Sequence: Synthetic oligonucleotide
  Target: ATXN1; (+) strand; PAM type: YTN; PAM sequence: CTA
tgtttgcttggtgccactta

SEQ ID NO: 304619 - DNA, 20 bp, Artificial Sequence
  Description of Artificial Sequence: Synthetic oligonucleotide
  Target: ATXN1; (+) strand; PAM type: YTN; PAM sequence: TTT
gcttggtgccacttaacagt

SEQ ID NO: 304620 - DNA, 20 bp, Artificial Sequence
  Description of Artificial Sequence: Synthetic oligonucleotide
  Target: ATXN1; (+) strand; PAM type: YTN; PAM sequence: TTG
cttggtgccacttaacagtc

SEQ ID NO: 304621 - DNA, 20 bp, Artificial Sequence
  Description of Artificial Sequence: Synthetic oligonucleotide
  Target: ATXN1; (+) strand; PAM type: YTN; PAM sequence: CTT
ggtgccacttaacagtcaac

SEQ ID NO: 304622 - DNA, 20 bp, Artificial Sequence
  Description of Artificial Sequence: Synthetic oligonucleotide
  Target: ATXN1; (+) strand; PAM type: YTN; PAM sequence: TTG
gtgccacttaacagtcaact

SEQ ID NO: 304623 - DNA, 20 bp, Artificial Sequence
  Description of Artificial Sequence: Synthetic oligonucleotide
  Target: ATXN1; (+) strand; PAM type: YTN; PAM sequence: CTT
aacagtcaactcatcccact

SEQ ID NO: 304624 - DNA, 20 bp, Artificial Sequence
  Description of Artificial Sequence: Synthetic oligonucleotide
  Target: ATXN1; (+) strand; PAM type: YTN; PAM sequence: TTA
acagtcaactcatcccactc

SEQ ID NO: 304625 - DNA, 20 bp, Artificial Sequence
  Description of Artificial Sequence: Synthetic oligonucleotide
  Target: ATXN1; (+) strand; PAM type: YTN; PAM sequence: CTC
atcccactcccttgttccga

SEQ ID NO: 304626 - DNA, 20 bp, Artificial Sequence
  Description of Artificial Sequence: Synthetic oligonucleotide
  Target: ATXN1; (+) strand; PAM type: YTN; PAM sequence: CTC
ccttgttccgattccctgct

SEQ ID NO: 304627 - DNA, 20 bp, Artificial Sequence
  Description of Artificial Sequence: Synthetic oligonucleotide
  Target: ATXN1; (+) strand; PAM type: YTN; PAM sequence: CTT
gttccgattccctgctcacc

SEQ ID NO: 304628 - DNA, 20 bp, Artificial Sequence
  Description of Artificial Sequence: Synthetic oligonucleotide
  Target: ATXN1; (+) strand; PAM type: YTN; PAM sequence: TTG
ttccgattccctgctcacca

SEQ ID NO: 304629 - DNA, 20 bp, Artificial Sequence
  Description of Artificial Sequence: Synthetic oligonucleotide
  Target: ATXN1; (+) strand; PAM type: YTN; PAM sequence: TTC
cgattccctgctcaccaagc

SEQ ID NO: 304630 - DNA, 20 bp, Artificial Sequence
  Description of Artificial Sequence: Synthetic oligonucleotide
  Target: ATXN1; (+) strand; PAM type: YTN; PAM sequence: TTC
cctgctcaccaagcaaacac

SEQ ID NO: 304631 - DNA, 20 bp, Artificial Sequence
  Description of Artificial Sequence: Synthetic oligonucleotide
  Target: ATXN1; (+) strand; PAM type: YTN; PAM sequence: CTG
ctcaccaagcaaacacctga

SEQ ID NO: 304632 - DNA, 20 bp, Artificial Sequence
  Description of Artificial Sequence: Synthetic oligonucleotide
  Target: ATXN1; (+) strand; PAM type: YTN; PAM sequence: CTC
accaagcaaacacctgactc

SEQ ID NO: 304633 - DNA, 20 bp, Artificial Sequence
  Description of Artificial Sequence: Synthetic oligonucleotide
  Target: ATXN1; (+) strand; PAM type: YTN; PAM sequence: CTG
actccatatggatcttcctt

SEQ ID NO: 304634 - DNA, 20 bp, Artificial Sequence
  Description of Artificial Sequence: Synthetic oligonucleotide
  Target: ATXN1; (+) strand; PAM type: YTN; PAM sequence: CTC
catatggatcttccttagag

SEQ ID NO: 304635 - DNA, 20 bp, Artificial Sequence
  Description of Artificial Sequence: Synthetic oligonucleotide
  Target: ATXN1; (+) strand; PAM type: YTN; PAM sequence: CTT
ccttagagagcatgtgcact

SEQ ID NO: 304636 - DNA, 20 bp, Artificial Sequence
  Description of Artificial Sequence: Synthetic oligonucleotide
  Target: ATXN1; (+) strand; PAM type: YTN; PAM sequence: TTC
cttagagagcatgtgcactg

SEQ ID NO: 304637 - DNA, 20 bp, Artificial Sequence
  Description of Artificial Sequence: Synthetic oligonucleotide
  Target: ATXN1; (+) strand; PAM type: YTN; PAM sequence: CTT
agagagcatgtgcactgtga

SEQ ID NO: 304638 - DNA, 20 bp, Artificial Sequence
  Description of Artificial Sequence: Synthetic oligonucleotide
  Target: ATXN1; (+) strand; PAM type: YTN; PAM sequence: TTA
gagagcatgtgcactgtgac

SEQ ID NO: 304639 - DNA, 20 bp, Artificial Sequence
  Description of Artificial Sequence: Synthetic oligonucleotide
  Target: ATXN1; (+) strand; PAM type: YTN; PAM sequence: CTG
tgactgctgctgatacctgc

SEQ ID NO: 304640 - DNA, 20 bp, Artificial Sequence
  Description of Artificial Sequence: Synthetic oligonucleotide
  Target: ATXN1; (+) strand; PAM type: YTN; PAM sequence: CTG
ctgctgatacctgcagccag

SEQ ID NO: 304641 - DNA, 20 bp, Artificial Sequence
  Description of Artificial Sequence: Synthetic oligonucleotide
  Target: ATXN1; (+) strand; PAM type: YTN; PAM sequence: CTG
ctgatacctgcagccagaga

SEQ ID NO: 304642 - DNA, 20 bp, Artificial Sequence
  Description of Artificial Sequence: Synthetic oligonucleotide
  Target: ATXN1; (+) strand; PAM type: YTN; PAM sequence: CTG
atacctgcagccagagagca

SEQ ID NO: 304643 - DNA, 20 bp, Artificial Sequence
  Description of Artificial Sequence: Synthetic oligonucleotide
  Target: ATXN1; (+) strand; PAM type: YTN; PAM sequence: CTG
cagccagagagcagcaattt

SEQ ID NO: 304644 - DNA, 20 bp, Artificial Sequence
  Description of Artificial Sequence: Synthetic oligonucleotide
  Target: ATXN1; (+) strand; PAM type: YTN; PAM sequence: TTT
ctcaaggcacatcaataaag

SEQ ID NO: 304645 - DNA, 20 bp, Artificial Sequence
  Description of Artificial Sequence: Synthetic oligonucleotide
  Target: ATXN1; (+) strand; PAM type: YTN; PAM sequence: TTC
tcaaggcacatcaataaagt

SEQ ID NO: 304646 - DNA, 20 bp, Artificial Sequence
  Description of Artificial Sequence: Synthetic oligonucleotide
  Target: ATXN1; (+) strand; PAM type: YTN; PAM sequence: CTC
aaggcacatcaataaagtag

SEQ ID NO: 304647 - DNA, 20 bp, Artificial Sequence
  Description of Artificial Sequence: Synthetic oligonucleotide
  Target: ATXN1; (+) strand; PAM type: YTN; PAM sequence: CTT
ccagttaggatttacattcc

SEQ ID NO: 304648 - DNA, 20 bp, Artificial Sequence
  Description of Artificial Sequence: Synthetic oligonucleotide
  Target: ATXN1; (+) strand; PAM type: YTN; PAM sequence: TTC
cagttaggatttacattccc

SEQ ID NO: 304649 - DNA, 20 bp, Artificial Sequence
  Description of Artificial Sequence: Synthetic oligonucleotide
  Target: ATXN1; (+) strand; PAM type: YTN; PAM sequence: TTA
ggatttacattcccatgcag

SEQ ID NO: 304650 - DNA, 20 bp, Artificial Sequence
  Description of Artificial Sequence: Synthetic oligonucleotide
  Target: ATXN1; (+) strand; PAM type: YTN; PAM sequence: TTT
acattcccatgcagcttaac

SEQ ID NO: 304651 - DNA, 20 bp, Artificial Sequence
  Description of Artificial Sequence: Synthetic oligonucleotide
  Target: ATXN1; (+) strand; PAM type: YTN; PAM sequence: TTA
cattcccatgcagcttaaca

SEQ ID NO: 304652 - DNA, 20 bp, Artificial Sequence
  Description of Artificial Sequence: Synthetic oligonucleotide
  Target: ATXN1; (+) strand; PAM type: YTN; PAM sequence: TTC
ccatgcagcttaacacagag

SEQ ID NO: 304653 - DNA, 20 bp, Artificial Sequence
  Description of Artificial Sequence: Synthetic oligonucleotide
  Target: ATXN1; (+) strand; PAM type: YTN; PAM sequence: CTT
aacacagagagagaatgtgc

SEQ ID NO: 304654 - DNA, 20 bp, Artificial Sequence
  Description of Artificial Sequence: Synthetic oligonucleotide
  Target: ATXN1; (+) strand; PAM type: YTN; PAM sequence: TTA
acacagagagagaatgtgct

SEQ ID NO: 304655 - DNA, 20 bp, Artificial Sequence
  Description of Artificial Sequence: Synthetic oligonucleotide
  Target: ATXN1; (+) strand; PAM type: YTN; PAM sequence: CTC
atcatgtgggccttgagagt

SEQ ID NO: 304656 - DNA, 20 bp, Artificial Sequence
  Description of Artificial Sequence: Synthetic oligonucleotide
  Target: ATXN1; (+) strand; PAM type: YTN; PAM sequence: CTT
gagagtatgttagtaatggt

SEQ ID NO: 304657 - DNA, 20 bp, Artificial Sequence
  Description of Artificial Sequence: Synthetic oligonucleotide
  Target: ATXN1; (+) strand; PAM type: YTN; PAM sequence: TTG
agagtatgttagtaatggtt

SEQ ID NO: 304658 - DNA, 20 bp, Artificial Sequence
  Description of Artificial Sequence: Synthetic oligonucleotide
  Target: ATXN1; (+) strand; PAM type: YTN; PAM sequence: TTA
gtaatggtttccactgcgga

SEQ ID NO: 304659 - DNA, 20 bp, Artificial Sequence
  Description of Artificial Sequence: Synthetic oligonucleotide
  Target: ATXN1; (+) strand; PAM type: YTN; PAM sequence: TTT
ccactgcggattaacattct

SEQ ID NO: 304660 - DNA, 20 bp, Artificial Sequence
  Description of Artificial Sequence: Synthetic oligonucleotide
  Target: ATXN1; (+) strand; PAM type: YTN; PAM sequence: TTC
cactgcggattaacattctg

SEQ ID NO: 304661 - DNA, 20 bp, Artificial Sequence
  Description of Artificial Sequence: Synthetic oligonucleotide
  Target: ATXN1; (+) strand; PAM type: YTN; PAM sequence: CTG
cggattaacattctggcata

SEQ ID NO: 304662 - DNA, 20 bp, Artificial Sequence
  Description of Artificial Sequence: Synthetic oligonucleotide
  Target: ATXN1; (+) strand; PAM type: YTN; PAM sequence: TTA
acattctggcataacgatct

SEQ ID NO: 304663 - DNA, 20 bp, Artificial Sequence
  Description of Artificial Sequence: Synthetic oligonucleotide
  Target: ATXN1; (+) strand; PAM type: YTN; PAM sequence: TTC
tggcataacgatctcgtggg

SEQ ID NO: 304664 - DNA, 20 bp, Artificial Sequence
  Description of Artificial Sequence: Synthetic oligonucleotide
  Target: ATXN1; (+) strand; PAM type: YTN; PAM sequence: CTG
gcataacgatctcgtgggtc

SEQ ID NO: 304665 - DNA, 20 bp, Artificial Sequence
  Description of Artificial Sequence: Synthetic oligonucleotide
  Target: ATXN1; (+) strand; PAM type: YTN; PAM sequence: CTC
gtgggtctgaggatatgctg

SEQ ID NO: 304666 - DNA, 20 bp, Artificial Sequence
  Description of Artificial Sequence: Synthetic oligonucleotide
  Target: ATXN1; (+) strand; PAM type: YTN; PAM sequence: CTG
aggatatgctggcatcatgg

SEQ ID NO: 304667 - DNA, 20 bp, Artificial Sequence
  Description of Artificial Sequence: Synthetic oligonucleotide
  Target: ATXN1; (+) strand; PAM type: YTN; PAM sequence: CTG
gcatcatggtctcaactcag

SEQ ID NO: 304668 - DNA, 20 bp, Artificial Sequence
  Description of Artificial Sequence: Synthetic oligonucleotide
  Target: ATXN1; (+) strand; PAM type: YTN; PAM sequence: CTC
aactcaggctcatctgtggc

SEQ ID NO: 304669 - DNA, 20 bp, Artificial Sequence
  Description of Artificial Sequence: Synthetic oligonucleotide
  Target: ATXN1; (+) strand; PAM type: YTN; PAM sequence: CTC
aggctcatctgtggcatagc

SEQ ID NO: 304670 - DNA, 20 bp, Artificial Sequence
  Description of Artificial Sequence: Synthetic oligonucleotide
  Target: ATXN1; (+) strand; PAM type: YTN; PAM sequence: CTC
atctgtggcatagctctctg

SEQ ID NO: 304671 - DNA, 20 bp, Artificial Sequence
  Description of Artificial Sequence: Synthetic oligonucleotide
  Target: ATXN1; (+) strand; PAM type: YTN; PAM sequence: CTG
tggcatagctctctgaatca

SEQ ID NO: 304672 - DNA, 20 bp, Artificial Sequence
  Description of Artificial Sequence: Synthetic oligonucleotide
  Target: ATXN1; (+) strand; PAM type: YTN; PAM sequence: CTC
tctgaatcagcatggcaagc

SEQ ID NO: 304673 - DNA, 20 bp, Artificial Sequence
  Description of Artificial Sequence: Synthetic oligonucleotide
  Target: ATXN1; (+) strand; PAM type: YTN; PAM sequence: CTC
tgaatcagcatggcaagccc

SEQ ID NO: 304674 - DNA, 20 bp, Artificial Sequence
  Description of Artificial Sequence: Synthetic oligonucleotide
  Target: ATXN1; (+) strand; PAM type: YTN; PAM sequence: CTG
aatcagcatggcaagccctg

SEQ ID NO: 304675 - DNA, 20 bp, Artificial Sequence
  Description of Artificial Sequence: Synthetic oligonucleotide
  Target: ATXN1; (+) strand; PAM type: YTN; PAM sequence: CTG
gacacagaccagaagccatc

SEQ ID NO: 304676 - DNA, 20 bp, Artificial Sequence
  Description of Artificial Sequence: Synthetic oligonucleotide
  Target: ATXN1; (+) strand; PAM type: YTN; PAM sequence: CTC
tagtctccaaaagcaggggc

SEQ ID NO: 304677 - DNA, 20 bp, Artificial Sequence
  Description of Artificial Sequence: Synthetic oligonucleotide
  Target: ATXN1; (+) strand; PAM type: YTN; PAM sequence: CTA
gtctccaaaagcaggggcag

SEQ ID NO: 304678 - DNA, 20 bp, Artificial Sequence
  Description of Artificial Sequence: Synthetic oligonucleotide
  Target: ATXN1; (+) strand; PAM type: YTN; PAM sequence: CTC
caaaagcaggggcagaaggc

SEQ ID NO: 304679 - DNA, 20 bp, Artificial Sequence
  Description of Artificial Sequence: Synthetic oligonucleotide
  Target: ATXN1; (+) strand; PAM type: YTN; PAM sequence: CTC
gctgacagcatggcttacac

SEQ ID NO: 304680 - DNA, 20 bp, Artificial Sequence
  Description of Artificial Sequence: Synthetic oligonucleotide
  Target: ATXN1; (+) strand; PAM type: YTN; PAM sequence: CTG
acagcatggcttacacgcca

SEQ ID NO: 304681 - DNA, 20 bp, Artificial Sequence
  Description of Artificial Sequence: Synthetic oligonucleotide
  Target: ATXN1; (+) strand; PAM type: YTN; PAM sequence: CTT
acacgccacttctggctcta

SEQ ID NO: 304682 - DNA, 20 bp, Artificial Sequence
  Description of Artificial Sequence: Synthetic oligonucleotide
  Target: ATXN1; (+) strand; PAM type: YTN; PAM sequence: TTA
cacgccacttctggctctac

SEQ ID NO: 304683 - DNA, 20 bp, Artificial Sequence
  Description of Artificial Sequence: Synthetic oligonucleotide
  Target: ATXN1; (+) strand; PAM type: YTN; PAM sequence: CTT
ctggctctactcactttcaa

SEQ ID NO: 304684 - DNA, 20 bp, Artificial Sequence
  Description of Artificial Sequence: Synthetic oligonucleotide
  Target: ATXN1; (+) strand; PAM type: YTN; PAM sequence: TTC
tggctctactcactttcaac

SEQ ID NO: 304685 - DNA, 20 bp, Artificial Sequence
  Description of Artificial Sequence: Synthetic oligonucleotide
  Target: ATXN1; (+) strand; PAM type: YTN; PAM sequence: CTG
gctctactcactttcaactg

SEQ ID NO: 304686 - DNA, 20 bp, Artificial Sequence
  Description of Artificial Sequence: Synthetic oligonucleotide
  Target: ATXN1; (+) strand; PAM type: YTN; PAM sequence: CTC
tactcactttcaactgattt

SEQ ID NO: 304687 - DNA, 20 bp, Artificial Sequence
  Description of Artificial Sequence: Synthetic oligonucleotide
  Target: ATXN1; (+) strand; PAM type: YTN; PAM sequence: CTA
ctcactttcaactgattttc

SEQ ID NO: 304688 - DNA, 20 bp, Artificial Sequence
  Description of Artificial Sequence: Synthetic oligonucleotide
  Target: ATXN1; (+) strand; PAM type: YTN; PAM sequence: CTC
actttcaactgattttcaca

SEQ ID NO: 304689 - DNA, 20 bp, Artificial Sequence
  Description of Artificial Sequence: Synthetic oligonucleotide
  Target: ATXN1; (+) strand; PAM type: YTN; PAM sequence: CTT
tcaactgattttcacagagc

SEQ ID NO: 304690 - DNA, 20 bp, Artificial Sequence
  Description of Artificial Sequence: Synthetic oligonucleotide
  Target: ATXN1; (+) strand; PAM type: YTN; PAM sequence: TTT
caactgattttcacagagct

SEQ ID NO: 304691 - DNA, 20 bp, Artificial Sequence
  Description of Artificial Sequence: Synthetic oligonucleotide
  Target: ATXN1; (+) strand; PAM type: YTN; PAM sequence: TTC
aactgattttcacagagctg

SEQ ID NO: 304692 - DNA, 20 bp, Artificial Sequence
  Description of Artificial Sequence: Synthetic oligonucleotide
  Target: ATXN1; (+) strand; PAM type: YTN; PAM sequence: CTG
attttcacagagctgtttag

SEQ ID NO: 304693 - DNA, 20 bp, Artificial Sequence
  Description of Artificial Sequence: Synthetic oligonucleotide
  Target: ATXN1; (+) strand; PAM type: YTN; PAM sequence: TTT
tcacagagctgtttaggatg

SEQ ID NO: 304694 - DNA, 20 bp, Artificial Sequence
  Description of Artificial Sequence: Synthetic oligonucleotide
  Target: ATXN1; (+) strand; PAM type: YTN; PAM sequence: TTT
cacagagctgtttaggatga

SEQ ID NO: 304695 - DNA, 20 bp, Artificial Sequence
  Description of Artificial Sequence: Synthetic oligonucleotide
  Target: ATXN1; (+) strand; PAM type: YTN; PAM sequence: TTC
acagagctgtttaggatgat

SEQ ID NO: 304696 - DNA, 20 bp, Artificial Sequence
  Description of Artificial Sequence: Synthetic oligonucleotide
  Target: ATXN1; (+) strand; PAM type: YTN; PAM sequence: CTG
tttaggatgatgaagccaaa

SEQ ID NO: 304697 - DNA, 20 bp, Artificial Sequence
  Description of Artificial Sequence: Synthetic oligonucleotide
  Target: ATXN1; (+) strand; PAM type: YTN; PAM sequence: TTT
aggatgatgaagccaaagaa

SEQ ID NO: 304698 - DNA, 20 bp, Artificial Sequence
  Description of Artificial Sequence: Synthetic oligonucleotide
  Target: ATXN1; (+) strand; PAM type: YTN; PAM sequence: TTA
ggatgatgaagccaaagaac

SEQ ID NO: 304699 - DNA, 20 bp, Artificial Sequence
  Description of Artificial Sequence: Synthetic oligonucleotide
  Target: ATXN1; (+) strand; PAM type: YTN; PAM sequence: CTG
gtgcttcaggacaaagtttc

SEQ ID NO: 304700 - DNA, 20 bp, Artificial Sequence
  Description of Artificial Sequence: Synthetic oligonucleotide
  Target: ATXN1; (+) strand; PAM type: YTN; PAM sequence: CTT
caggacaaagtttctgtttg

SEQ ID NO: 304701 - DNA, 20 bp, Artificial Sequence
  Description of Artificial Sequence: Synthetic oligonucleotide
  Target: ATXN1; (+) strand; PAM type: YTN; PAM sequence: TTC
aggacaaagtttctgtttgc

SEQ ID NO: 304702 - DNA, 20 bp, Artificial Sequence
  Description of Artificial Sequence: Synthetic oligonucleotide
  Target: ATXN1; (+) strand; PAM type: YTN; PAM sequence: TTT
ctgtttgcttccctatacat

SEQ ID NO: 304703 - DNA, 20 bp, Artificial Sequence
  Description of Artificial Sequence: Synthetic oligonucleotide
  Target: ATXN1; (+) strand; PAM type: YTN; PAM sequence: TTC
tgtttgcttccctatacatg

SEQ ID NO: 304704 - DNA, 20 bp, Artificial Sequence
  Description of Artificial Sequence: Synthetic oligonucleotide
  Target: ATXN1; (+) strand; PAM type: YTN; PAM sequence: CTG
tttgcttccctatacatgta

SEQ ID NO: 304705 - DNA, 20 bp, Artificial Sequence
  Description of Artificial Sequence: Synthetic oligonucleotide
  Target: ATXN1; (+) strand; PAM type: YTN; PAM sequence: TTT
gcttccctatacatgtatag

SEQ ID NO: 304706 - DNA, 20 bp, Artificial Sequence
  Description of Artificial Sequence: Synthetic oligonucleotide
  Target: ATXN1; (+) strand; PAM type: YTN; PAM sequence: TTG
cttccctatacatgtataga

SEQ ID NO: 304707 - DNA, 20 bp, Artificial Sequence
  Description of Artificial Sequence: Synthetic oligonucleotide
  Target: ATXN1; (+) strand; PAM type: YTN; PAM sequence: CTT
ccctatacatgtatagaatg

SEQ ID NO: 304708 - DNA, 20 bp, Artificial Sequence
  Description of Artificial Sequence: Synthetic oligonucleotide
  Target: ATXN1; (+) strand; PAM type: YTN; PAM sequence: TTC
cctatacatgtatagaatgg

SEQ ID NO: 304709 - DNA, 20 bp, Artificial Sequence
  Description of Artificial Sequence: Synthetic oligonucleotide
  Target: ATXN1; (+) strand; PAM type: YTN; PAM sequence: CTA
tacatgtatagaatggaaac

SEQ ID NO: 304710 - DNA, 20 bp, Artificial Sequence
  Description of Artificial Sequence: Synthetic oligonucleotide
  Target: ATXN1; (+) strand; PAM type: YTN; PAM sequence: CTG
gcacaagatttaattaagtg

SEQ ID NO: 304711 - DNA, 20 bp, Artificial Sequence
  Description of Artificial Sequence: Synthetic oligonucleotide
  Target: ATXN1; (+) strand; PAM type: YTN; PAM sequence: TTT
aattaagtgatgtaaaaacc

SEQ ID NO: 304712 - DNA, 20 bp, Artificial Sequence
  Description of Artificial Sequence: Synthetic oligonucleotide
  Target: ATXN1; (+) strand; PAM type: YTN; PAM sequence: TTA
attaagtgatgtaaaaacca

SEQ ID NO: 304713 - DNA, 20 bp, Artificial Sequence
  Description of Artificial Sequence: Synthetic oligonucleotide
  Target: ATXN1; (+) strand; PAM type: YTN; PAM sequence: TTA
agtgatgtaaaaaccagagg

SEQ ID NO: 304714 - DNA, 20 bp, Artificial Sequence
  Description of Artificial Sequence: Synthetic oligonucleotide
  Target: ATXN1; (+) strand; PAM type: YTN; PAM sequence: TTA
gtgactggcagagttgccac

SEQ ID NO: 304715 - DNA, 20 bp, Artificial Sequence
  Description of Artificial Sequence: Synthetic oligonucleotide
  Target: ATXN1; (+) strand; PAM type: YTN; PAM sequence: CTG
gcagagttgccacacaacaa

SEQ ID NO: 304716 - DNA, 20 bp, Artificial Sequence
  Description of Artificial Sequence: Synthetic oligonucleotide
  Target: ATXN1; (+) strand; PAM type: YTN; PAM sequence: TTG
ccacacaacaaggtgcaatg

SEQ ID NO: 304717 - DNA, 20 bp, Artificial Sequence
  Description of Artificial Sequence: Synthetic oligonucleotide
  Target: ATXN1; (+) strand; PAM type: YTN; PAM sequence: TTT
atgtgtttctttaaaaaatc

SEQ ID NO: 304718 - DNA, 20 bp, Artificial Sequence
  Description of Artificial Sequence: Synthetic oligonucleotide
  Target: ATXN1; (+) strand; PAM type: YTN; PAM sequence: TTA
tgtgtttctttaaaaaatct

SEQ ID NO: 304719 - DNA, 20 bp, Artificial Sequence
  Description of Artificial Sequence: Synthetic oligonucleotide
  Target: ATXN1; (+) strand; PAM type: YTN; PAM sequence: TTT
ctttaaaaaatctaaatcat

SEQ ID NO: 304720 - DNA, 20 bp, Artificial Sequence
  Description of Artificial Sequence: Synthetic oligonucleotide
  Target: ATXN1; (+) strand; PAM type: YTN; PAM sequence: TTC
tttaaaaaatctaaatcata

SEQ ID NO: 304721 - DNA, 20 bp, Artificial Sequence
  Description of Artificial Sequence: Synthetic oligonucleotide
  Target: ATXN1; (+) strand; PAM type: YTN; PAM sequence: CTT
taaaaaatctaaatcatagt

SEQ ID NO: 304722 - DNA, 20 bp, Artificial Sequence
  Description of Artificial Sequence: Synthetic oligonucleotide
  Target: ATXN1; (+) strand; PAM type: YTN; PAM sequence: TTT
aaaaaatctaaatcatagtg

SEQ ID NO: 304723 - DNA, 20 bp, Artificial Sequence
  Description of Artificial Sequence: Synthetic oligonucleotide
  Target: ATXN1; (+) strand; PAM type: YTN; PAM sequence: TTA
aaaaatctaaatcatagtga

SEQ ID NO: 304724 - DNA, 20 bp, Artificial Sequence
  Description of Artificial Sequence: Synthetic oligonucleotide
  Target: ATXN1; (+) strand; PAM type: YTN; PAM sequence: CTA
aatcatagtgaagggtcaat

SEQ ID NO: 304725 - DNA, 20 bp, Artificial Sequence
  Description of Artificial Sequence: Synthetic oligonucleotide
  Target: ATXN1; (+) strand; PAM type: YTN; PAM sequence: CTC
ttttgccctattaagcagaa

SEQ ID NO: 304726 - DNA, 20 bp, Artificial Sequence
  Description of Artificial Sequence: Synthetic oligonucleotide
  Target: ATXN1; (+) strand; PAM type: YTN; PAM sequence: CTT
ttgccctattaagcagaaaa

SEQ ID NO: 304727 - DNA, 20 bp, Artificial Sequence
  Description of Artificial Sequence: Synthetic oligonucleotide
  Target: ATXN1; (+) strand; PAM type: YTN; PAM sequence: TTT
tgccctattaagcagaaaac

SEQ ID NO: 304728 - DNA, 20 bp, Artificial Sequence
  Description of Artificial Sequence: Synthetic oligonucleotide
  Target: ATXN1; (+) strand; PAM type: YTN; PAM sequence: TTT
gccctattaagcagaaaaca

SEQ ID NO: 304729 - DNA, 20 bp, Artificial Sequence
  Description of Artificial Sequence: Synthetic oligonucleotide
  Target: ATXN1; (+) strand; PAM type: YTN; PAM sequence: TTG
ccctattaagcagaaaacaa

SEQ ID NO: 304730 - DNA, 20 bp, Artificial Sequence
  Description of Artificial Sequence: Synthetic oligonucleotide
  Target: ATXN1; (+) strand; PAM type: YTN; PAM sequence: CTA
ttaagcagaaaacaaaggct

SEQ ID NO: 304731 - DNA, 20 bp, Artificial Sequence
  Description of Artificial Sequence: Synthetic oligonucleotide
  Target: ATXN1; (+) strand; PAM type: YTN; PAM sequence: TTA
agcagaaaacaaaggctcag

SEQ ID NO: 304732 - DNA, 20 bp, Artificial Sequence
  Description of Artificial Sequence: Synthetic oligonucleotide
  Target: ATXN1; (+) strand; PAM type: YTN; PAM sequence: CTC
agtgtatagaagttagaaaa

SEQ ID NO: 304733 - DNA, 20 bp, Artificial Sequence
  Description of Artificial Sequence: Synthetic oligonucleotide
  Target: ATXN1; (+) strand; PAM type: YTN; PAM sequence: TTA
gaaaacttttagccacaaaa

SEQ ID NO: 304734 - DNA, 20 bp, Artificial Sequence
  Description of Artificial Sequence: Synthetic oligonucleotide
  Target: ATXN1; (+) strand; PAM type: YTN; PAM sequence: CTT
ttagccacaaaaatatgaca

SEQ ID NO: 304735 - DNA, 20 bp, Artificial Sequence
  Description of Artificial Sequence: Synthetic oligonucleotide
  Target: ATXN1; (+) strand; PAM type: YTN; PAM sequence: TTT
tagccacaaaaatatgacag

SEQ ID NO: 304736 - DNA, 20 bp, Artificial Sequence
  Description of Artificial Sequence: Synthetic oligonucleotide
  Target: ATXN1; (+) strand; PAM type: YTN; PAM sequence: TTT
agccacaaaaatatgacagt

SEQ ID NO: 304737 - DNA, 20 bp, Artificial Sequence
  Description of Artificial Sequence: Synthetic oligonucleotide
  Target: ATXN1; (+) strand; PAM type: YTN; PAM sequence: TTA
gccacaaaaatatgacagtg

SEQ ID NO: 304738 - DNA, 20 bp, Artificial Sequence
  Description of Artificial Sequence: Synthetic oligonucleotide
  Target: ATXN1; (+) strand; PAM type: YTN; PAM sequence: TTA
tgcctcttaataatatgcat

SEQ ID NO: 304739 - DNA, 20 bp, Artificial Sequence
  Description of Artificial Sequence: Synthetic oligonucleotide
  Target: ATXN1; (+) strand; PAM type: YTN; PAM sequence: CTC
ttaataatatgcatggggca

SEQ ID NO: 304740 - DNA, 20 bp, Artificial Sequence
  Description of Artificial Sequence: Synthetic oligonucleotide
  Target: ATXN1; (+) strand; PAM type: YTN; PAM sequence: CTT
aataatatgcatggggcaaa

SEQ ID NO: 304741 - DNA, 20 bp, Artificial Sequence
  Description of Artificial Sequence: Synthetic oligonucleotide
  Target: ATXN1; (+) strand; PAM type: YTN; PAM sequence: TTA
ataatatgcatggggcaaaa

SEQ ID NO: 304742 - DNA, 20 bp, Artificial Sequence
  Description of Artificial Sequence: Synthetic oligonucleotide
  Target: ATXN1; (+) strand; PAM type: YTN; PAM sequence: TTC
cagaaagaaggtcagtgcct

SEQ ID NO: 304743 - DNA, 20 bp, Artificial Sequence
  Description of Artificial Sequence: Synthetic oligonucleotide
  Target: ATXN1; (+) strand; PAM type: YTN; PAM sequence: CTG
ttttgcctaaatcttgccag

SEQ ID NO: 304744 - DNA, 20 bp, Artificial Sequence
  Description of Artificial Sequence: Synthetic oligonucleotide
  Target: ATXN1; (+) strand; PAM type: YTN; PAM sequence: TTT
tgcctaaatcttgccaggat

SEQ ID NO: 304745 - DNA, 20 bp, Artificial Sequence
  Description of Artificial Sequence: Synthetic oligonucleotide
  Target: ATXN1; (+) strand; PAM type: YTN; PAM sequence: TTT
gcctaaatcttgccaggata

SEQ ID NO: 304746 - DNA, 20 bp, Artificial Sequence
  Description of Artificial Sequence: Synthetic oligonucleotide
  Target: ATXN1; (+) strand; PAM type: YTN; PAM sequence: TTG
cctaaatcttgccaggatat

SEQ ID NO: 304747 - DNA, 20 bp, Artificial Sequence
  Description of Artificial Sequence: Synthetic oligonucleotide
  Target: ATXN1; (+) strand; PAM type: YTN; PAM sequence: CTA
aatcttgccaggatatgcaa

SEQ ID NO: 304748 - DNA, 20 bp, Artificial Sequence
  Description of Artificial Sequence: Synthetic oligonucleotide
  Target: ATXN1; (+) strand; PAM type: YTN; PAM sequence: CTT
gccaggatatgcaaggccaa

SEQ ID NO: 304749 - DNA, 20 bp, Artificial Sequence
  Description of Artificial Sequence: Synthetic oligonucleotide
  Target: ATXN1; (+) strand; PAM type: YTN; PAM sequence: TTG
ccaggatatgcaaggccaaa

SEQ ID NO: 304750 - DNA, 20 bp, Artificial Sequence
  Description of Artificial Sequence: Synthetic oligonucleotide
  Target: ATXN1; (+) strand; PAM type: YTN; PAM sequence: CTA
actgcaacggagcaagaatg

SEQ ID NO: 304751 - DNA, 20 bp, Artificial Sequence
  Description of Artificial Sequence: Synthetic oligonucleotide
  Target: ATXN1; (+) strand; PAM type: YTN; PAM sequence: CTG
caacggagcaagaatgcaaa

SEQ ID NO: 304752 - DNA, 20 bp, Artificial Sequence
  Description of Artificial Sequence: Synthetic oligonucleotide
  Target: ATXN1; (+) strand; PAM type: YTN; PAM sequence: CTC
ctttcctgttaactgtgaca

SEQ ID NO: 304753 - DNA, 20 bp, Artificial Sequence
  Description of Artificial Sequence: Synthetic oligonucleotide
  Target: ATXN1; (+) strand; PAM type: YTN; PAM sequence: CTT
tcctgttaactgtgacataa

SEQ ID NO: 304754 - DNA, 20 bp, Artificial Sequence
  Description of Artificial Sequence: Synthetic oligonucleotide
  Target: ATXN1; (+) strand; PAM type: YTN; PAM sequence: TTT
cctgttaactgtgacataat

SEQ ID NO: 304755 - DNA, 20 bp, Artificial Sequence
  Description of Artificial Sequence: Synthetic oligonucleotide
  Target: ATXN1; (+) strand; PAM type: YTN; PAM sequence: TTC
ctgttaactgtgacataatt

SEQ ID NO: 304756 - DNA, 20 bp, Artificial Sequence
  Description of Artificial Sequence: Synthetic oligonucleotide
  Target: ATXN1; (+) strand; PAM type: YTN; PAM sequence: CTG
ttaactgtgacataattcat

SEQ ID NO: 304757 - DNA, 20 bp, Artificial Sequence
  Description of Artificial Sequence: Synthetic oligonucleotide
  Target: ATXN1; (+) strand; PAM type: YTN; PAM sequence: TTA
actgtgacataattcatttt

SEQ ID NO: 304758 - DNA, 20 bp, Artificial Sequence
  Description of Artificial Sequence: Synthetic oligonucleotide
  Target: ATXN1; (+) strand; PAM type: YTN; PAM sequence: CTG
tgacataattcatttttctc

SEQ ID NO: 304759 - DNA, 20 bp, Artificial Sequence
  Description of Artificial Sequence: Synthetic oligonucleotide
  Target: ATXN1; (+) strand; PAM type: YTN; PAM sequence: TTC
atttttctccttctgttcca

SEQ ID NO: 304760 - DNA, 20 bp, Artificial Sequence
  Description of Artificial Sequence: Synthetic oligonucleotide
  Target: ATXN1; (+) strand; PAM type: YTN; PAM sequence: TTT
ttctccttctgttccagaac

SEQ ID NO: 304761 - DNA, 20 bp, Artificial Sequence
  Description of Artificial Sequence: Synthetic oligonucleotide
  Target: ATXN1; (+) strand; PAM type: YTN; PAM sequence: TTT
tctccttctgttccagaact

SEQ ID NO: 304762 - DNA, 20 bp, Artificial Sequence
  Description of Artificial Sequence: Synthetic oligonucleotide
  Target: ATXN1; (+) strand; PAM type: YTN; PAM sequence: TTT
ctccttctgttccagaactt

SEQ ID NO: 304763 - DNA, 20 bp, Artificial Sequence
  Description of Artificial Sequence: Synthetic oligonucleotide
  Target: ATXN1; (+) strand; PAM type: YTN; PAM sequence: TTC
tccttctgttccagaacttc

SEQ ID NO: 304764 - DNA, 20 bp, Artificial Sequence
  Description of Artificial Sequence: Synthetic oligonucleotide
  Target: ATXN1; (+) strand; PAM type: YTN; PAM sequence: CTC
cttctgttccagaacttcta

SEQ ID NO: 304765 - DNA, 20 bp, Artificial Sequence
  Description of Artificial Sequence: Synthetic oligonucleotide
  Target: ATXN1; (+) strand; PAM type: YTN; PAM sequence: CTT
ctgttccagaacttctaacc

SEQ ID NO: 304766 - DNA, 20 bp, Artificial Sequence
  Description of Artificial Sequence: Synthetic oligonucleotide
  Target: ATXN1; (+) strand; PAM type: YTN; PAM sequence: TTC
tgttccagaacttctaacct

SEQ ID NO: 304767 - DNA, 20 bp, Artificial Sequence
  Description of Artificial Sequence: Synthetic oligonucleotide
  Target: ATXN1; (+) strand; PAM type: YTN; PAM sequence: CTG
ttccagaacttctaacctat

SEQ ID NO: 304768 - DNA, 20 bp, Artificial Sequence
  Description of Artificial Sequence: Synthetic oligonucleotide
  Target: ATXN1; (+) strand; PAM type: YTN; PAM sequence: TTC
cagaacttctaacctatagg

SEQ ID NO: 304769 - DNA, 20 bp, Artificial Sequence
  Description of Artificial Sequence: Synthetic oligonucleotide
  Target: ATXN1; (+) strand; PAM type: YTN; PAM sequence: CTT
ctaacctataggtcatgctt

SEQ ID NO: 304770 - DNA, 20 bp, Artificial Sequence
  Description of Artificial Sequence: Synthetic oligonucleotide
  Target: ATXN1; (+) strand; PAM type: YTN; PAM sequence: TTC
taacctataggtcatgctta

SEQ ID NO: 304771 - DNA, 20 bp, Artificial Sequence
  Description of Artificial Sequence: Synthetic oligonucleotide
  Target: ATXN1; (+) strand; PAM type: YTN; PAM sequence: CTA
acctataggtcatgcttata

SEQ ID NO: 304772 - DNA, 20 bp, Artificial Sequence
  Description of Artificial Sequence: Synthetic oligonucleotide
  Target: ATXN1; (+) strand; PAM type: YTN; PAM sequence: CTA
taggtcatgcttatacccac

SEQ ID NO: 304773 - DNA, 20 bp, Artificial Sequence
  Description of Artificial Sequence: Synthetic oligonucleotide
  Target: ATXN1; (+) strand; PAM type: YTN; PAM sequence: CTT
atacccacagaagaaccaag

SEQ ID NO: 304774 - DNA, 20 bp, Artificial Sequence
  Description of Artificial Sequence: Synthetic oligonucleotide
  Target: ATXN1; (+) strand; PAM type: YTN; PAM sequence: TTA
tacccacagaagaaccaagg

SEQ ID NO: 304775 - DNA, 20 bp, Artificial Sequence
  Description of Artificial Sequence: Synthetic oligonucleotide
  Target: ATXN1; (+) strand; PAM type: YTN; PAM sequence: CTG
ctggtttccaaagaaaatgc

SEQ ID NO: 304776 - DNA, 20 bp, Artificial Sequence
  Description of Artificial Sequence: Synthetic oligonucleotide
  Target: ATXN1; (+) strand; PAM type: YTN; PAM sequence: CTG
gtttccaaagaaaatgctta

SEQ ID NO: 304777 - DNA, 20 bp, Artificial Sequence
  Description of Artificial Sequence: Synthetic oligonucleotide
  Target: ATXN1; (+) strand; PAM type: YTN; PAM sequence: TTT
ccaaagaaaatgcttacttc

SEQ ID NO: 304778 - DNA, 20 bp, Artificial Sequence
  Description of Artificial Sequence: Synthetic oligonucleotide
  Target: ATXN1; (+) strand; PAM type: YTN; PAM sequence: TTC
caaagaaaatgcttacttcc

SEQ ID NO: 304779 - DNA, 20 bp, Artificial Sequence
  Description of Artificial Sequence: Synthetic oligonucleotide
  Target: ATXN1; (+) strand; PAM type: YTN; PAM sequence: CTT
acttcccatttgcaaagcgt

SEQ ID NO: 304780 - DNA, 20 bp, Artificial Sequence
  Description of Artificial Sequence: Synthetic oligonucleotide
  Target: ATXN1; (+) strand; PAM type: YTN; PAM sequence: TTA
cttcccatttgcaaagcgtt

SEQ ID NO: 304781 - DNA, 20 bp, Artificial Sequence
  Description of Artificial Sequence: Synthetic oligonucleotide
  Target: ATXN1; (+) strand; PAM type: YTN; PAM sequence: CTT
cccatttgcaaagcgtttcg

SEQ ID NO: 304782 - DNA, 20 bp, Artificial Sequence
  Description of Artificial Sequence: Synthetic oligonucleotide
  Target: ATXN1; (+) strand; PAM type: YTN; PAM sequence: TTC
ccatttgcaaagcgtttcgc

SEQ ID NO: 304783 - DNA, 20 bp, Artificial Sequence
  Description of Artificial Sequence: Synthetic oligonucleotide
  Target: ATXN1; (+) strand; PAM type: YTN; PAM sequence: TTT
gcaaagcgtttcgctggaaa

SEQ ID NO: 304784 - DNA, 20 bp, Artificial Sequence
  Description of Artificial Sequence: Synthetic oligonucleotide
  Target: ATXN1; (+) strand; PAM type: YTN; PAM sequence: TTG
caaagcgtttcgctggaaat

SEQ ID NO: 304785 - DNA, 20 bp, Artificial Sequence
  Description of Artificial Sequence: Synthetic oligonucleotide
  Target: ATXN1; (+) strand; PAM type: YTN; PAM sequence: TTT
cgctggaaatgctgtgttga

SEQ ID NO: 304786 - DNA, 20 bp, Artificial Sequence
  Description of Artificial Sequence: Synthetic oligonucleotide
  Target: ATXN1; (+) strand; PAM type: YTN; PAM sequence: TTC
gctggaaatgctgtgttgag

SEQ ID NO: 304787 - DNA, 20 bp, Artificial Sequence
  Description of Artificial Sequence: Synthetic oligonucleotide
  Target: ATXN1; (+) strand; PAM type: YTN; PAM sequence: CTG
gaaatgctgtgttgagttac

SEQ ID NO: 304788 - DNA, 20 bp, Artificial Sequence
  Description of Artificial Sequence: Synthetic oligonucleotide
  Target: ATXN1; (+) strand; PAM type: YTN; PAM sequence: CTG
tgttgagttacaccatccaa

SEQ ID NO: 304789 - DNA, 20 bp, Artificial Sequence
  Description of Artificial Sequence: Synthetic oligonucleotide
  Target: ATXN1; (+) strand; PAM type: YTN; PAM sequence: TTG
agttacaccatccaactagg

SEQ ID NO: 304790 - DNA, 20 bp, Artificial Sequence
  Description of Artificial Sequence: Synthetic oligonucleotide
  Target: ATXN1; (+) strand; PAM type: YTN; PAM sequence: TTA
caccatccaactaggaatta

SEQ ID NO: 304791 - DNA, 20 bp, Artificial Sequence
  Description of Artificial Sequence: Synthetic oligonucleotide
  Target: ATXN1; (+) strand; PAM type: YTN; PAM sequence: CTA
ggaattaaatatattatgct

SEQ ID NO: 304792 - DNA, 20 bp, Artificial Sequence
  Description of Artificial Sequence: Synthetic oligonucleotide
  Target: ATXN1; (+) strand; PAM type: YTN; PAM sequence: TTA
aatatattatgctctttggt

SEQ ID NO: 304793 - DNA, 20 bp, Artificial Sequence
  Description of Artificial Sequence: Synthetic oligonucleotide
  Target: ATXN1; (+) strand; PAM type: YTN; PAM sequence: TTA
tgctctttggtaaattatca

SEQ ID NO: 304794 - DNA, 20 bp, Artificial Sequence
  Description of Artificial Sequence: Synthetic oligonucleotide
  Target: ATXN1; (+) strand; PAM type: YTN; PAM sequence: CTC
tttggtaaattatcaaaatg

SEQ ID NO: 304795 - DNA, 20 bp, Artificial Sequence
  Description of Artificial Sequence: Synthetic oligonucleotide
  Target: ATXN1; (+) strand; PAM type: YTN; PAM sequence: CTT
tggtaaattatcaaaatgta

SEQ ID NO: 304796 - DNA, 20 bp, Artificial Sequence
  Description of Artificial Sequence: Synthetic oligonucleotide
  Target: ATXN1; (+) strand; PAM type: YTN; PAM sequence: TTT
ggtaaattatcaaaatgtaa

SEQ ID NO: 304797 - DNA, 20 bp, Artificial Sequence
  Description of Artificial Sequence: Synthetic oligonucleotide
  Target: ATXN1; (+) strand; PAM type: YTN; PAM sequence: TTG
gtaaattatcaaaatgtaaa

SEQ ID NO: 304798 - DNA, 20 bp, Artificial Sequence
  Description of Artificial Sequence: Synthetic oligonucleotide
  Target: ATXN1; (+) strand; PAM type: YTN; PAM sequence: TTA
tcaaaatgtaaaccaacagc

SEQ ID NO: 304799 - DNA, 20 bp, Artificial Sequence
  Description of Artificial Sequence: Synthetic oligonucleotide
  Target: ATXN1; (+) strand; PAM type: YTN; PAM sequence: CTA
cagtggagaccatctgaact

SEQ ID NO: 304800 - DNA, 20 bp, Artificial Sequence
  Description of Artificial Sequence: Synthetic oligonucleotide
  Target: ATXN1; (+) strand; PAM type: YTN; PAM sequence: CTG
aactgccaagagttttaaca

SEQ ID NO: 304801 - DNA, 20 bp, Artificial Sequence
  Description of Artificial Sequence: Synthetic oligonucleotide
  Target: ATXN1; (+) strand; PAM type: YTN; PAM sequence: CTG
ccaagagttttaacactgtg

SEQ ID NO: 304802 - DNA, 20 bp, Artificial Sequence
  Description of Artificial Sequence: Synthetic oligonucleotide
  Target: ATXN1; (+) strand; PAM type: YTN; PAM sequence: TTT
taacactgtgattttagtga

SEQ ID NO: 304803 - DNA, 20 bp, Artificial Sequence
  Description of Artificial Sequence: Synthetic oligonucleotide
  Target: ATXN1; (+) strand; PAM type: YTN; PAM sequence: TTT
aacactgtgattttagtgag

SEQ ID NO: 304804 - DNA, 20 bp, Artificial Sequence
  Description of Artificial Sequence: Synthetic oligonucleotide
  Target: ATXN1; (+) strand; PAM type: YTN; PAM sequence: TTA
acactgtgattttagtgaga

SEQ ID NO: 304805 - DNA, 20 bp, Artificial Sequence
  Description of Artificial Sequence: Synthetic oligonucleotide
  Target: ATXN1; (+) strand; PAM type: YTN; PAM sequence: CTG
tgattttagtgagaaagaac

SEQ ID NO: 304806 - DNA, 20 bp, Artificial Sequence
  Description of Artificial Sequence: Synthetic oligonucleotide
  Target: ATXN1; (+) strand; PAM type: YTN; PAM sequence: TTT
tagtgagaaagaacatttcc

SEQ ID NO: 304807 - DNA, 20 bp, Artificial Sequence
  Description of Artificial Sequence: Synthetic oligonucleotide
  Target: ATXN1; (+) strand; PAM type: YTN; PAM sequence: TTT
agtgagaaagaacatttccc

SEQ ID NO: 304808 - DNA, 20 bp, Artificial Sequence
  Description of Artificial Sequence: Synthetic oligonucleotide
  Target: ATXN1; (+) strand; PAM type: YTN; PAM sequence: TTA
gtgagaaagaacatttcccc

SEQ ID NO: 304809 - DNA, 20 bp, Artificial Sequence
  Description of Artificial Sequence: Synthetic oligonucleotide
  Target: ATXN1; (+) strand; PAM type: YTN; PAM sequence: TTT
cccctgctgtttagttttca

SEQ ID NO: 304810 - DNA, 20 bp, Artificial Sequence
  Description of Artificial Sequence: Synthetic oligonucleotide
  Target: ATXN1; (+) strand; PAM type: YTN; PAM sequence: TTC
ccctgctgtttagttttcag

SEQ ID NO: 304811 - DNA, 20 bp, Artificial Sequence
  Description of Artificial Sequence: Synthetic oligonucleotide
  Target: ATXN1; (+) strand; PAM type: YTN; PAM sequence: CTG
ctgtttagttttcagctaag

SEQ ID NO: 304812 - DNA, 20 bp, Artificial Sequence
  Description of Artificial Sequence: Synthetic oligonucleotide
  Target: ATXN1; (+) strand; PAM type: YTN; PAM sequence: CTG
tttagttttcagctaagttc

SEQ ID NO: 304813 - DNA, 20 bp, Artificial Sequence
  Description of Artificial Sequence: Synthetic oligonucleotide
  Target: ATXN1; (+) strand; PAM type: YTN; PAM sequence: TTT
agttttcagctaagttcagc

SEQ ID NO: 304814 - DNA, 20 bp, Artificial Sequence
  Description of Artificial Sequence: Synthetic oligonucleotide
  Target: ATXN1; (+) strand; PAM type: YTN; PAM sequence: TTA
gttttcagctaagttcagcc

SEQ ID NO: 304815 - DNA, 20 bp, Artificial Sequence
  Description of Artificial Sequence: Synthetic oligonucleotide
  Target: ATXN1; (+) strand; PAM type: YTN; PAM sequence: TTT
tcagctaagttcagcctagc

SEQ ID NO: 304816 - DNA, 20 bp, Artificial Sequence
  Description of Artificial Sequence: Synthetic oligonucleotide
  Target: ATXN1; (+) strand; PAM type: YTN; PAM sequence: TTT
cagctaagttcagcctagct

SEQ ID NO: 304817 - DNA, 20 bp, Artificial Sequence
  Description of Artificial Sequence: Synthetic oligonucleotide
  Target: ATXN1; (+) strand; PAM type: YTN; PAM sequence: TTC
agctaagttcagcctagctg

SEQ ID NO: 304818 - DNA, 20 bp, Artificial Sequence
  Description of Artificial Sequence: Synthetic oligonucleotide
  Target: ATXN1; (+) strand; PAM type: YTN; PAM sequence: CTA
agttcagcctagctgtttag

SEQ ID NO: 304819 - DNA, 20 bp, Artificial Sequence
  Description of Artificial Sequence: Synthetic oligonucleotide
  Target: ATXN1; (+) strand; PAM type: YTN; PAM sequence: TTC
agcctagctgtttagttttc

SEQ ID NO: 304820 - DNA, 20 bp, Artificial Sequence
  Description of Artificial Sequence: Synthetic oligonucleotide
  Target: ATXN1; (+) strand; PAM type: YTN; PAM sequence: CTA
gctgtttagttttcagctag

SEQ ID NO: 304821 - DNA, 20 bp, Artificial Sequence
  Description of Artificial Sequence: Synthetic oligonucleotide
  Target: ATXN1; (+) strand; PAM type: YTN; PAM sequence: CTG
tttagttttcagctagcttc

SEQ ID NO: 304822 - DNA, 20 bp, Artificial Sequence
  Description of Artificial Sequence: Synthetic oligonucleotide
  Target: ATXN1; (+) strand; PAM type: YTN; PAM sequence: TTT
agttttcagctagcttcata

SEQ ID NO: 304823 - DNA, 20 bp, Artificial Sequence
  Description of Artificial Sequence: Synthetic oligonucleotide
  Target: ATXN1; (+) strand; PAM type: YTN; PAM sequence: TTA
gttttcagctagcttcatac

SEQ ID NO: 304824 - DNA, 20 bp, Artificial Sequence
  Description of Artificial Sequence: Synthetic oligonucleotide
  Target: ATXN1; (+) strand; PAM type: YTN; PAM sequence: TTT
tcagctagcttcatacaaag

SEQ ID NO: 304825 - DNA, 20 bp, Artificial Sequence
  Description of Artificial Sequence: Synthetic oligonucleotide
  Target: ATXN1; (+) strand; PAM type: YTN; PAM sequence: TTT
cagctagcttcatacaaagc

SEQ ID NO: 304826 - DNA, 20 bp, Artificial Sequence
  Description of Artificial Sequence: Synthetic oligonucleotide
  Target: ATXN1; (+) strand; PAM type: YTN; PAM sequence: TTC
agctagcttcatacaaagct

SEQ ID NO: 304827 - DNA, 20 bp, Artificial Sequence
  Description of Artificial Sequence: Synthetic oligonucleotide
  Target: ATXN1; (+) strand; PAM type: YTN; PAM sequence: CTA
gcttcatacaaagctgtgca

SEQ ID NO: 304828 - DNA, 20 bp, Artificial Sequence
  Description of Artificial Sequence: Synthetic oligonucleotide
  Target: ATXN1; (+) strand; PAM type: YTN; PAM sequence: CTT
catacaaagctgtgcattgt

SEQ ID NO: 304829 - DNA, 20 bp, Artificial Sequence
  Description of Artificial Sequence: Synthetic oligonucleotide
  Target: ATXN1; (+) strand; PAM type: YTN; PAM sequence: TTC
atacaaagctgtgcattgta

SEQ ID NO: 304830 - DNA, 20 bp, Artificial Sequence
  Description of Artificial Sequence: Synthetic oligonucleotide
  Target: ATXN1; (+) strand; PAM type: YTN; PAM sequence: CTG
tgcattgtacgcacagatgt

SEQ ID NO: 304831 - DNA, 20 bp, Artificial Sequence
  Description of Artificial Sequence: Synthetic oligonucleotide
  Target: ATXN1; (+) strand; PAM type: YTN; PAM sequence: TTG
tacgcacagatgtgtgcaca

SEQ ID NO: 304832 - DNA, 20 bp, Artificial Sequence
  Description of Artificial Sequence: Synthetic oligonucleotide
  Target: ATXN1; (+) strand; PAM type: YTN; PAM sequence: CTT
ttgttcataggtttttactg

SEQ ID NO: 304833 - DNA, 20 bp, Artificial Sequence
  Description of Artificial Sequence: Synthetic oligonucleotide
  Target: ATXN1; (+) strand; PAM type: YTN; PAM sequence: TTT
tgttcataggtttttactgg

SEQ ID NO: 304834 - DNA, 20 bp, Artificial Sequence
  Description of Artificial Sequence: Synthetic oligonucleotide
  Target: ATXN1; (+) strand; PAM type: YTN; PAM sequence: TTT
gttcataggtttttactggg

SEQ ID NO: 304835 - DNA, 20 bp, Artificial Sequence
  Description of Artificial Sequence: Synthetic oligonucleotide
  Target: ATXN1; (+) strand; PAM type: YTN; PAM sequence: TTG
ttcataggtttttactggga

SEQ ID NO: 304836 - DNA, 20 bp, Artificial Sequence
  Description of Artificial Sequence: Synthetic oligonucleotide
  Target: ATXN1; (+) strand; PAM type: YTN; PAM sequence: TTC
ataggtttttactgggaatt

SEQ ID NO: 304837 - DNA, 20 bp, Artificial Sequence
  Description of Artificial Sequence: Synthetic oligonucleotide
  Target: ATXN1; (+) strand; PAM type: YTN; PAM sequence: TTT
ttactgggaattttcacata

SEQ ID NO: 304838 - DNA, 20 bp, Artificial Sequence
  Description of Artificial Sequence: Synthetic oligonucleotide
  Target: ATXN1; (+) strand; PAM type: YTN; PAM sequence: TTT
tactgggaattttcacatag

SEQ ID NO: 304839 - DNA, 20 bp, Artificial Sequence
  Description of Artificial Sequence: Synthetic oligonucleotide
  Target: ATXN1; (+) strand; PAM type: YTN; PAM sequence: TTT
actgggaattttcacatagg

SEQ ID NO: 304840 - DNA, 20 bp, Artificial Sequence
  Description of Artificial Sequence: Synthetic oligonucleotide
  Target: ATXN1; (+) strand; PAM type: YTN; PAM sequence: TTA
ctgggaattttcacatagga

SEQ ID NO: 304841 - DNA, 20 bp, Artificial Sequence
  Description of Artificial Sequence: Synthetic oligonucleotide
  Target: ATXN1; (+) strand; PAM type: YTN; PAM sequence: CTG
ggaattttcacataggattc

SEQ ID NO: 304842 - DNA, 20 bp, Artificial Sequence
  Description of Artificial Sequence: Synthetic oligonucleotide
  Target: ATXN1; (+) strand; PAM type: YTN; PAM sequence: TTT
tcacataggattcattaagt

SEQ ID NO: 304843 - DNA, 20 bp, Artificial Sequence
  Description of Artificial Sequence: Synthetic oligonucleotide
  Target: ATXN1; (+) strand; PAM type: YTN; PAM sequence: TTT
cacataggattcattaagtg

SEQ ID NO: 304844 - DNA, 20 bp, Artificial Sequence
  Description of Artificial Sequence: Synthetic oligonucleotide
  Target: ATXN1; (+) strand; PAM type: YTN; PAM sequence: TTC
acataggattcattaagtga

SEQ ID NO: 304845 - DNA, 20 bp, Artificial Sequence
  Description of Artificial Sequence: Synthetic oligonucleotide
  Target: ATXN1; (+) strand; PAM type: YTN; PAM sequence: TTC
attaagtgaaggtatgtagc

SEQ ID NO: 304846 - DNA, 20 bp, Artificial Sequence
  Description of Artificial Sequence: Synthetic oligonucleotide
  Target: ATXN1; (+) strand; PAM type: YTN; PAM sequence: TTA
agtgaaggtatgtagcatga

SEQ ID NO: 304847 - DNA, 20 bp, Artificial Sequence
  Description of Artificial Sequence: Synthetic oligonucleotide
  Target: ATXN1; (+) strand; PAM type: YTN; PAM sequence: CTG
tcatttcctaagtttttcta

SEQ ID NO: 304848 - DNA, 20 bp, Artificial Sequence
  Description of Artificial Sequence: Synthetic oligonucleotide
  Target: ATXN1; (+) strand; PAM type: YTN; PAM sequence: TTT
cctaagtttttctacccacc

SEQ ID NO: 304849 - DNA, 20 bp, Artificial Sequence
  Description of Artificial Sequence: Synthetic oligonucleotide
  Target: ATXN1; (+) strand; PAM type: YTN; PAM sequence: TTC
ctaagtttttctacccacca

SEQ ID NO: 304850 - DNA, 20 bp, Artificial Sequence
  Description of Artificial Sequence: Synthetic oligonucleotide
  Target: ATXN1; (+) strand; PAM type: YTN; PAM sequence: CTA
agtttttctacccaccataa

SEQ ID NO: 304851 - DNA, 20 bp, Artificial Sequence
  Description of Artificial Sequence: Synthetic oligonucleotide
  Target: ATXN1; (+) strand; PAM type: YTN; PAM sequence: TTT
ttctacccaccataatttgg

SEQ ID NO: 304852 - DNA, 20 bp, Artificial Sequence
  Description of Artificial Sequence: Synthetic oligonucleotide
  Target: ATXN1; (+) strand; PAM type: YTN; PAM sequence: TTT
tctacccaccataatttggg

SEQ ID NO: 304853 - DNA, 20 bp, Artificial Sequence
  Description of Artificial Sequence: Synthetic oligonucleotide
  Target: ATXN1; (+) strand; PAM type: YTN; PAM sequence: TTT
ctacccaccataatttggga

SEQ ID NO: 304854 - DNA, 20 bp, Artificial Sequence
  Description of Artificial Sequence: Synthetic oligonucleotide
  Target: ATXN1; (+) strand; PAM type: YTN; PAM sequence: TTC
tacccaccataatttgggaa

SEQ ID NO: 304855 - DNA, 20 bp, Artificial Sequence
  Description of Artificial Sequence: Synthetic oligonucleotide
  Target: ATXN1; (+) strand; PAM type: YTN; PAM sequence: CTA
cccaccataatttgggaagt

SEQ ID NO: 304856 - DNA, 20 bp, Artificial Sequence
  Description of Artificial Sequence: Synthetic oligonucleotide
  Target: ATXN1; (+) strand; PAM type: YTN; PAM sequence: TTT
gggaagtggctttgtttctc

SEQ ID NO: 304857 - DNA, 20 bp, Artificial Sequence
  Description of Artificial Sequence: Synthetic oligonucleotide
  Target: ATXN1; (+) strand; PAM type: YTN; PAM sequence: TTG
ggaagtggctttgtttctct

SEQ ID NO: 304858 - DNA, 20 bp, Artificial Sequence
  Description of Artificial Sequence: Synthetic oligonucleotide
  Target: ATXN1; (+) strand; PAM type: YTN; PAM sequence: CTT
tgtttctctgactactagac

SEQ ID NO: 304859 - DNA, 20 bp, Artificial Sequence
  Description of Artificial Sequence: Synthetic oligonucleotide
  Target: ATXN1; (+) strand; PAM type: YTN; PAM sequence: TTT
gtttctctgactactagact

SEQ ID NO: 304860 - DNA, 20 bp, Artificial Sequence
  Description of Artificial Sequence: Synthetic oligonucleotide
  Target: ATXN1; (+) strand; PAM type: YTN; PAM sequence: TTG
tttctctgactactagactt

SEQ ID NO: 304861 - DNA, 20 bp, Artificial Sequence
  Description of Artificial Sequence: Synthetic oligonucleotide
  Target: ATXN1; (+) strand; PAM type: YTN; PAM sequence: TTT
ctctgactactagacttcct

SEQ ID NO: 304862 - DNA, 20 bp, Artificial Sequence
  Description of Artificial Sequence: Synthetic oligonucleotide
  Target: ATXN1; (+) strand; PAM type: YTN; PAM sequence: TTC
tctgactactagacttcctg

SEQ ID NO: 304863 - DNA, 20 bp, Artificial Sequence
  Description of Artificial Sequence: Synthetic oligonucleotide
  Target: ATXN1; (+) strand; PAM type: YTN; PAM sequence: CTC
tgactactagacttcctggg

SEQ ID NO: 304864 - DNA, 20 bp, Artificial Sequence
  Description of Artificial Sequence: Synthetic oligonucleotide
  Target: ATXN1; (+) strand; PAM type: YTN; PAM sequence: CTG
actactagacttcctgggga

SEQ ID NO: 304865 - DNA, 20 bp, Artificial Sequence
  Description of Artificial Sequence: Synthetic oligonucleotide
  Target: ATXN1; (+) strand; PAM type: YTN; PAM sequence: CTA
ctagacttcctggggactct

SEQ ID NO: 304866 - DNA, 20 bp, Artificial Sequence
  Description of Artificial Sequence: Synthetic oligonucleotide
  Target: ATXN1; (+) strand; PAM type: YTN; PAM sequence: CTA
gacttcctggggactctgtc

SEQ ID NO: 304867 - DNA, 20 bp, Artificial Sequence
  Description of Artificial Sequence: Synthetic oligonucleotide
  Target: ATXN1; (+) strand; PAM type: YTN; PAM sequence: CTT
cctggggactctgtctttat

SEQ ID NO: 304868 - DNA, 20 bp, Artificial Sequence
  Description of Artificial Sequence: Synthetic oligonucleotide
  Target: ATXN1; (+) strand; PAM type: YTN; PAM sequence: TTC
ctggggactctgtctttatt

SEQ ID NO: 304869 - DNA, 20 bp, Artificial Sequence
  Description of Artificial Sequence: Synthetic oligonucleotide
  Target: ATXN1; (+) strand; PAM type: YTN; PAM sequence: CTG
gggactctgtctttatttcc

SEQ ID NO: 304870 - DNA, 20 bp, Artificial Sequence
  Description of Artificial Sequence: Synthetic oligonucleotide
  Target: ATXN1; (+) strand; PAM type: YTN; PAM sequence: CTC
tgtctttatttcccggggac

SEQ ID NO: 304871 - DNA, 20 bp, Artificial Sequence
  Description of Artificial Sequence: Synthetic oligonucleotide
  Target: ATXN1; (+) strand; PAM type: YTN; PAM sequence: CTG
tctttatttcccggggactc

SEQ ID NO: 304872 - DNA, 20 bp, Artificial Sequence
  Description of Artificial Sequence: Synthetic oligonucleotide
  Target: ATXN1; (+) strand; PAM type: YTN; PAM sequence: CTT
tatttcccggggactctgtc

SEQ ID NO: 304873 - DNA, 20 bp, Artificial Sequence
  Description of Artificial Sequence: Synthetic oligonucleotide
  Target: ATXN1; (+) strand; PAM type: YTN; PAM sequence: TTT
atttcccggggactctgtct

SEQ ID NO: 304874 - DNA, 20 bp, Artificial Sequence
  Description of Artificial Sequence: Synthetic oligonucleotide
  Target: ATXN1; (+) strand; PAM type: YTN; PAM sequence: TTA
tttcccggggactctgtctt

SEQ ID NO: 304875 - DNA, 20 bp, Artificial Sequence
  Description of Artificial Sequence: Synthetic oligonucleotide
  Target: ATXN1; (+) strand; PAM type: YTN; PAM sequence: TTT
cccggggactctgtctttat

SEQ ID NO: 304876 - DNA, 20 bp, Artificial Sequence
  Description of Artificial Sequence: Synthetic oligonucleotide
  Target: ATXN1; (+) strand; PAM type: YTN; PAM sequence: TTC
ccggggactctgtctttatt

SEQ ID NO: 304877 - DNA, 20 bp, Artificial Sequence
  Description of Artificial Sequence: Synthetic oligonucleotide
  Target: ATXN1; (+) strand; PAM type: YTN; PAM sequence: CTC
tgtctttatttcccataaca

SEQ ID NO: 304878 - DNA, 20 bp, Artificial Sequence
  Description of Artificial Sequence: Synthetic oligonucleotide
  Target: ATXN1; (+) strand; PAM type: YTN; PAM sequence: CTG
tctttatttcccataacatt

SEQ ID NO: 304879 - DNA, 20 bp, Artificial Sequence
  Description of Artificial Sequence: Synthetic oligonucleotide
  Target: ATXN1; (+) strand; PAM type: YTN; PAM sequence: CTT
tatttcccataacatttgca

SEQ ID NO: 304880 - DNA, 20 bp, Artificial Sequence
  Description of Artificial Sequence: Synthetic oligonucleotide
  Target: ATXN1; (+) strand; PAM type: YTN; PAM sequence: TTT
atttcccataacatttgcag

SEQ ID NO: 304881 - DNA, 20 bp, Artificial Sequence
  Description of Artificial Sequence: Synthetic oligonucleotide
  Target: ATXN1; (+) strand; PAM type: YTN; PAM sequence: TTA
tttcccataacatttgcaga

SEQ ID NO: 304882 - DNA, 20 bp, Artificial Sequence
  Description of Artificial Sequence: Synthetic oligonucleotide
  Target: ATXN1; (+) strand; PAM type: YTN; PAM sequence: TTT
cccataacatttgcagagtg

SEQ ID NO: 304883 - DNA, 20 bp, Artificial Sequence
  Description of Artificial Sequence: Synthetic oligonucleotide
  Target: ATXN1; (+) strand; PAM type: YTN; PAM sequence: TTC
ccataacatttgcagagtgc

SEQ ID NO: 304884 - DNA, 20 bp, Artificial Sequence
  Description of Artificial Sequence: Synthetic oligonucleotide
  Target: ATXN1; (+) strand; PAM type: YTN; PAM sequence: TTT
gcagagtgccatgcacacaa

SEQ ID NO: 304885 - DNA, 20 bp, Artificial Sequence
  Description of Artificial Sequence: Synthetic oligonucleotide
  Target: ATXN1; (+) strand; PAM type: YTN; PAM sequence: TTG
cagagtgccatgcacacaat

SEQ ID NO: 304886 - DNA, 20 bp, Artificial Sequence
  Description of Artificial Sequence: Synthetic oligonucleotide
  Target: ATXN1; (+) strand; PAM type: YTN; PAM sequence: CTT
aataaacatttgttgaatga

SEQ ID NO: 304887 - DNA, 20 bp, Artificial Sequence
  Description of Artificial Sequence: Synthetic oligonucleotide
  Target: ATXN1; (+) strand; PAM type: YTN; PAM sequence: TTA
ataaacatttgttgaatgat

SEQ ID NO: 304888 - DNA, 20 bp, Artificial Sequence
  Description of Artificial Sequence: Synthetic oligonucleotide
  Target: ATXN1; (+) strand; PAM type: YTN; PAM sequence: TTT
gttgaatgattcatctccac

SEQ ID NO: 304889 - DNA, 20 bp, Artificial Sequence
  Description of Artificial Sequence: Synthetic oligonucleotide
  Target: ATXN1; (+) strand; PAM type: YTN; PAM sequence: TTG
ttgaatgattcatctccaca

SEQ ID NO: 304890 - DNA, 20 bp, Artificial Sequence
  Description of Artificial Sequence: Synthetic oligonucleotide
  Target: ATXN1; (+) strand; PAM type: YTN; PAM sequence: TTG
aatgattcatctccacaata

SEQ ID NO: 304891 - DNA, 20 bp, Artificial Sequence
  Description of Artificial Sequence: Synthetic oligonucleotide
  Target: ATXN1; (+) strand; PAM type: YTN; PAM sequence: TTC
atctccacaatatcaacgca

SEQ ID NO: 304892 - DNA, 20 bp, Artificial Sequence
  Description of Artificial Sequence: Synthetic oligonucleotide
  Target: ATXN1; (+) strand; PAM type: YTN; PAM sequence: CTC
cacaatatcaacgcaattaa

SEQ ID NO: 304893 - DNA, 20 bp, Artificial Sequence
  Description of Artificial Sequence: Synthetic oligonucleotide
  Target: ATXN1; (+) strand; PAM type: YTN; PAM sequence: TTA
agagaaatctggcctttcac

SEQ ID NO: 304894 - DNA, 20 bp, Artificial Sequence
  Description of Artificial Sequence: Synthetic oligonucleotide
  Target: ATXN1; (+) strand; PAM type: YTN; PAM sequence: CTG
gcctttcacgtgaatttatg

SEQ ID NO: 304895 - DNA, 20 bp, Artificial Sequence
  Description of Artificial Sequence: Synthetic oligonucleotide
  Target: ATXN1; (+) strand; PAM type: YTN; PAM sequence: CTT
tcacgtgaatttatgataca

SEQ ID NO: 304896 - DNA, 20 bp, Artificial Sequence
  Description of Artificial Sequence: Synthetic oligonucleotide
  Target: ATXN1; (+) strand; PAM type: YTN; PAM sequence: TTT
cacgtgaatttatgatacaa

SEQ ID NO: 304897 - DNA, 20 bp, Artificial Sequence
  Description of Artificial Sequence: Synthetic oligonucleotide
  Target: ATXN1; (+) strand; PAM type: YTN; PAM sequence: TTC
acgtgaatttatgatacaag

SEQ ID NO: 304898 - DNA, 20 bp, Artificial Sequence
  Description of Artificial Sequence: Synthetic oligonucleotide
  Target: ATXN1; (+) strand; PAM type: YTN; PAM sequence: TTT
atgatacaagcaaaataagc

SEQ ID NO: 304899 - DNA, 20 bp, Artificial Sequence
  Description of Artificial Sequence: Synthetic oligonucleotide
  Target: ATXN1; (+) strand; PAM type: YTN; PAM sequence: TTA
tgatacaagcaaaataagca

SEQ ID NO: 304900 - DNA, 20 bp, Artificial Sequence
  Description of Artificial Sequence: Synthetic oligonucleotide
  Target: ATXN1; (+) strand; PAM type: YTN; PAM sequence: TTT
taaagctctttagtcctctg

SEQ ID NO: 304901 - DNA, 20 bp, Artificial Sequence
  Description of Artificial Sequence: Synthetic oligonucleotide
  Target: ATXN1; (+) strand; PAM type: YTN; PAM sequence: TTT
aaagctctttagtcctctgt

SEQ ID NO: 304902 - DNA, 20 bp, Artificial Sequence
  Description of Artificial Sequence: Synthetic oligonucleotide
  Target: ATXN1; (+) strand; PAM type: YTN; PAM sequence: TTA
aagctctttagtcctctgtc

SEQ ID NO: 304903 - DNA, 20 bp, Artificial Sequence
  Description of Artificial Sequence: Synthetic oligonucleotide
  Target: ATXN1; (+) strand; PAM type: YTN; PAM sequence: CTC
tttagtcctctgtcttctta

SEQ ID NO: 304904 - DNA, 20 bp, Artificial Sequence
  Description of Artificial Sequence: Synthetic oligonucleotide
  Target: ATXN1; (+) strand; PAM type: YTN; PAM sequence: CTT
tagtcctctgtcttcttata

SEQ ID NO: 304905 - DNA, 20 bp, Artificial Sequence
  Description of Artificial Sequence: Synthetic oligonucleotide
  Target: ATXN1; (+) strand; PAM type: YTN; PAM sequence: TTT
agtcctctgtcttcttatat

SEQ ID NO: 304906 - DNA, 20 bp, Artificial Sequence
  Description of Artificial Sequence: Synthetic oligonucleotide
  Target: ATXN1; (+) strand; PAM type: YTN; PAM sequence: TTA
gtcctctgtcttcttatata

SEQ ID NO: 304907 - DNA, 20 bp, Artificial Sequence
  Description of Artificial Sequence: Synthetic oligonucleotide
  Target: ATXN1; (+) strand; PAM type: YTN; PAM sequence: CTC
tgtcttcttatatagaaaac

SEQ ID NO: 304908 - DNA, 20 bp, Artificial Sequence
  Description of Artificial Sequence: Synthetic oligonucleotide
  Target: ATXN1; (+) strand; PAM type: YTN; PAM sequence: CTG
tcttcttatatagaaaacta

SEQ ID NO: 304909 - DNA, 20 bp, Artificial Sequence
  Description of Artificial Sequence: Synthetic oligonucleotide
  Target: ATXN1; (+) strand; PAM type: YTN; PAM sequence: CTT
cttatatagaaaactattca

SEQ ID NO: 304910 - DNA, 20 bp, Artificial Sequence
  Description of Artificial Sequence: Synthetic oligonucleotide
  Target: ATXN1; (+) strand; PAM type: YTN; PAM sequence: TTC
ttatatagaaaactattcag

SEQ ID NO: 304911 - DNA, 20 bp, Artificial Sequence
  Description of Artificial Sequence: Synthetic oligonucleotide
  Target: ATXN1; (+) strand; PAM type: YTN; PAM sequence: CTT
atatagaaaactattcagta

SEQ ID NO: 304912 - DNA, 20 bp, Artificial Sequence
  Description of Artificial Sequence: Synthetic oligonucleotide
  Target: ATXN1; (+) strand; PAM type: YTN; PAM sequence: TTA
tatagaaaactattcagtat

SEQ ID NO: 304913 - DNA, 20 bp, Artificial Sequence
  Description of Artificial Sequence: Synthetic oligonucleotide
  Target: ATXN1; (+) strand; PAM type: YTN; PAM sequence: CTA
ttcagtatttctacatcaaa

SEQ ID NO: 304914 - DNA, 20 bp, Artificial Sequence
  Description of Artificial Sequence: Synthetic oligonucleotide
  Target: ATXN1; (+) strand; PAM type: YTN; PAM sequence: TTC
agtatttctacatcaaaaat

SEQ ID NO: 304915 - DNA, 20 bp, Artificial Sequence
  Description of Artificial Sequence: Synthetic oligonucleotide
  Target: ATXN1; (+) strand; PAM type: YTN; PAM sequence: TTT
ctacatcaaaaattctccag

SEQ ID NO: 304916 - DNA, 20 bp, Artificial Sequence
  Description of Artificial Sequence: Synthetic oligonucleotide
  Target: ATXN1; (+) strand; PAM type: YTN; PAM sequence: TTC
tacatcaaaaattctccagg

SEQ ID NO: 304917 - DNA, 20 bp, Artificial Sequence
  Description of Artificial Sequence: Synthetic oligonucleotide
  Target: ATXN1; (+) strand; PAM type: YTN; PAM sequence: CTA
catcaaaaattctccaggga

SEQ ID NO: 304918 - DNA, 20 bp, Artificial Sequence
  Description of Artificial Sequence: Synthetic oligonucleotide
  Target: ATXN1; (+) strand; PAM type: YTN; PAM sequence: TTC
tccagggaaggataaacata

SEQ ID NO: 304919 - DNA, 20 bp, Artificial Sequence
  Description of Artificial Sequence: Synthetic oligonucleotide
  Target: ATXN1; (+) strand; PAM type: YTN; PAM sequence: CTC
cagggaaggataaacataca

SEQ ID NO: 304920 - DNA, 20 bp, Artificial Sequence
  Description of Artificial Sequence: Synthetic oligonucleotide
  Target: ATXN1; (+) strand; PAM type: YTN; PAM sequence: TTT
ttttatacattcccccaaag

SEQ ID NO: 304921 - DNA, 20 bp, Artificial Sequence
  Description of Artificial Sequence: Synthetic oligonucleotide
  Target: ATXN1; (+) strand; PAM type: YTN; PAM sequence: TTT
tttatacattcccccaaagc

SEQ ID NO: 304922 - DNA, 20 bp, Artificial Sequence
  Description of Artificial Sequence: Synthetic oligonucleotide
  Target: ATXN1; (+) strand; PAM type: YTN; PAM sequence: TTT
ttatacattcccccaaagca

SEQ ID NO: 304923 - DNA, 20 bp, Artificial Sequence
  Description of Artificial Sequence: Synthetic oligonucleotide
  Target: ATXN1; (+) strand; PAM type: YTN; PAM sequence: TTT
tatacattcccccaaagcac

SEQ ID NO: 304924 - DNA, 20 bp, Artificial Sequence
  Description of Artificial Sequence: Synthetic oligonucleotide
  Target: ATXN1; (+) strand; PAM type: YTN; PAM sequence: TTT
atacattcccccaaagcaca

SEQ ID NO: 304925 - DNA, 20 bp, Artificial Sequence
  Description of Artificial Sequence: Synthetic oligonucleotide
  Target: ATXN1; (+) strand; PAM type: YTN; PAM sequence: TTA
tacattcccccaaagcacag

SEQ ID NO: 304926 - DNA, 20 bp, Artificial Sequence
  Description of Artificial Sequence: Synthetic oligonucleotide
  Target: ATXN1; (+) strand; PAM type: YTN; PAM sequence: TTC
ccccaaagcacaggaagaaa

SEQ ID NO: 304927 - DNA, 20 bp, Artificial Sequence
  Description of Artificial Sequence: Synthetic oligonucleotide
  Target: ATXN1; (+) strand; PAM type: YTN; PAM sequence: CTT
tatttcatttgtgcaaattg

SEQ ID NO: 304928 - DNA, 20 bp, Artificial Sequence
  Description of Artificial Sequence: Synthetic oligonucleotide
  Target: ATXN1; (+) strand; PAM type: YTN; PAM sequence: TTT
atttcatttgtgcaaattga

SEQ ID NO: 304929 - DNA, 20 bp, Artificial Sequence
  Description of Artificial Sequence: Synthetic oligonucleotide
  Target: ATXN1; (+) strand; PAM type: YTN; PAM sequence: TTA
tttcatttgtgcaaattgat

SEQ ID NO: 304930 - DNA, 20 bp, Artificial Sequence
  Description of Artificial Sequence: Synthetic oligonucleotide
  Target: ATXN1; (+) strand; PAM type: YTN; PAM sequence: TTT
catttgtgcaaattgataga

SEQ ID NO: 304931 - DNA, 20 bp, Artificial Sequence
  Description of Artificial Sequence: Synthetic oligonucleotide
  Target: ATXN1; (+) strand; PAM type: YTN; PAM sequence: TTC
atttgtgcaaattgatagat

SEQ ID NO: 304932 - DNA, 20 bp, Artificial Sequence
  Description of Artificial Sequence: Synthetic oligonucleotide
  Target: ATXN1; (+) strand; PAM type: YTN; PAM sequence: TTT
gtgcaaattgatagatcacc

SEQ ID NO: 304933 - DNA, 20 bp, Artificial Sequence
  Description of Artificial Sequence: Synthetic oligonucleotide
  Target: ATXN1; (+) strand; PAM type: YTN; PAM sequence: TTG
tgcaaattgatagatcacct

SEQ ID NO: 304934 - DNA, 20 bp, Artificial Sequence
  Description of Artificial Sequence: Synthetic oligonucleotide
  Target: ATXN1; (+) strand; PAM type: YTN; PAM sequence: TTG
atagatcaccttttgaattc

SEQ ID NO: 304935 - DNA, 20 bp, Artificial Sequence
  Description of Artificial Sequence: Synthetic oligonucleotide
  Target: ATXN1; (+) strand; PAM type: YTN; PAM sequence: CTT
ttgaattcatgctaaacagc

SEQ ID NO: 304936 - DNA, 20 bp, Artificial Sequence
  Description of Artificial Sequence: Synthetic oligonucleotide
  Target: ATXN1; (+) strand; PAM type: YTN; PAM sequence: TTT
tgaattcatgctaaacagct

SEQ ID NO: 304937 - DNA, 20 bp, Artificial Sequence
  Description of Artificial Sequence: Synthetic oligonucleotide
  Target: ATXN1; (+) strand; PAM type: YTN; PAM sequence: TTT
gaattcatgctaaacagcta

SEQ ID NO: 304938 - DNA, 20 bp, Artificial Sequence
  Description of Artificial Sequence: Synthetic oligonucleotide
  Target: ATXN1; (+) strand; PAM type: YTN; PAM sequence: TTG
aattcatgctaaacagctaa

SEQ ID NO: 304939 - DNA, 20 bp, Artificial Sequence
  Description of Artificial Sequence: Synthetic oligonucleotide
  Target: ATXN1; (+) strand; PAM type: YTN; PAM sequence: TTC
atgctaaacagctaaatgtc

SEQ ID NO: 304940 - DNA, 20 bp, Artificial Sequence
  Description of Artificial Sequence: Synthetic oligonucleotide
  Target: ATXN1; (+) strand; PAM type: YTN; PAM sequence: CTA
aacagctaaatgtcgcaagc

SEQ ID NO: 304941 - DNA, 20 bp, Artificial Sequence
  Description of Artificial Sequence: Synthetic oligonucleotide
  Target: ATXN1; (+) strand; PAM type: YTN; PAM sequence: CTA
aatgtcgcaagcagcatgct

SEQ ID NO: 304942 - DNA, 20 bp, Artificial Sequence
  Description of Artificial Sequence: Synthetic oligonucleotide
  Target: ATXN1; (+) strand; PAM type: YTN; PAM sequence: CTG
tcaaaaactgtcaagtgaaa

SEQ ID NO: 304943 - DNA, 20 bp, Artificial Sequence
  Description of Artificial Sequence: Synthetic oligonucleotide
  Target: ATXN1; (+) strand; PAM type: YTN; PAM sequence: CTG
tcaagtgaaataattattga

SEQ ID NO: 304944 - DNA, 20 bp, Artificial Sequence
  Description of Artificial Sequence: Synthetic oligonucleotide
  Target: ATXN1; (+) strand; PAM type: YTN; PAM sequence: TTA
ttgattggtgcattaaaatt

SEQ ID NO: 304945 - DNA, 20 bp, Artificial Sequence
  Description of Artificial Sequence: Synthetic oligonucleotide
  Target: ATXN1; (+) strand; PAM type: YTN; PAM sequence: TTG
attggtgcattaaaattaaa

SEQ ID NO: 304946 - DNA, 20 bp, Artificial Sequence
  Description of Artificial Sequence: Synthetic oligonucleotide
  Target: ATXN1; (+) strand; PAM type: YTN; PAM sequence: TTG
gtgcattaaaattaaaaacg

SEQ ID NO: 304947 - DNA, 20 bp, Artificial Sequence
  Description of Artificial Sequence: Synthetic oligonucleotide
  Target: ATXN1; (+) strand; PAM type: YTN; PAM sequence: TTA
aaattaaaaacgaatgtaga

SEQ ID NO: 304948 - DNA, 20 bp, Artificial Sequence
  Description of Artificial Sequence: Synthetic oligonucleotide
  Target: ATXN1; (+) strand; PAM type: YTN; PAM sequence: TTA
aaaacgaatgtagattaata

SEQ ID NO: 304949 - DNA, 20 bp, Artificial Sequence
  Description of Artificial Sequence: Synthetic oligonucleotide
  Target: ATXN1; (+) strand; PAM type: YTN; PAM sequence: TTA
ataaatgaagatggctttaa

SEQ ID NO: 304950 - DNA, 20 bp, Artificial Sequence
  Description of Artificial Sequence: Synthetic oligonucleotide
  Target: ATXN1; (+) strand; PAM type: YTN; PAM sequence: CTT
taagaaaaagcatgtcatct

SEQ ID NO: 304951 - DNA, 20 bp, Artificial Sequence
  Description of Artificial Sequence: Synthetic oligonucleotide
  Target: ATXN1; (+) strand; PAM type: YTN; PAM sequence: TTT
aagaaaaagcatgtcatcta

SEQ ID NO: 304952 - DNA, 20 bp, Artificial Sequence
  Description of Artificial Sequence: Synthetic oligonucleotide
  Target: ATXN1; (+) strand; PAM type: YTN; PAM sequence: TTA
agaaaaagcatgtcatctac

SEQ ID NO: 304953 - DNA, 20 bp, Artificial Sequence
  Description of Artificial Sequence: Synthetic oligonucleotide
  Target: ATXN1; (+) strand; PAM type: YTN; PAM sequence: CTA
caactagaaaaacccgacag

SEQ ID NO: 304954 - DNA, 20 bp, Artificial Sequence
  Description of Artificial Sequence: Synthetic oligonucleotide
  Target: ATXN1; (+) strand; PAM type: YTN; PAM sequence: CTA
gaaaaacccgacagcgaatc

SEQ ID NO: 304955 - DNA, 20 bp, Artificial Sequence
  Description of Artificial Sequence: Synthetic oligonucleotide
  Target: ATXN1; (+) strand; PAM type: YTN; PAM sequence: CTG
ccagtcagggctatagggct

SEQ ID NO: 304956 - DNA, 20 bp, Artificial Sequence
  Description of Artificial Sequence: Synthetic oligonucleotide
  Target: ATXN1; (+) strand; PAM type: YTN; PAM sequence: CTA
tagggcttagaatgaaagat

SEQ ID NO: 304957 - DNA, 20 bp, Artificial Sequence
  Description of Artificial Sequence: Synthetic oligonucleotide
  Target: ATXN1; (+) strand; PAM type: YTN; PAM sequence: CTT
agaatgaaagattaaagagg

SEQ ID NO: 304958 - DNA, 20 bp, Artificial Sequence
  Description of Artificial Sequence: Synthetic oligonucleotide
  Target: ATXN1; (+) strand; PAM type: YTN; PAM sequence: TTA
gaatgaaagattaaagagga

SEQ ID NO: 304959 - DNA, 20 bp, Artificial Sequence
  Description of Artificial Sequence: Synthetic oligonucleotide
  Target: ATXN1; (+) strand; PAM type: YTN; PAM sequence: TTA
aagaggaaacaagaataaga

SEQ ID NO: 304960 - DNA, 20 bp, Artificial Sequence
  Description of Artificial Sequence: Synthetic oligonucleotide
  Target: ATXN1; (+) strand; PAM type: YTN; PAM sequence: TTA
accacacaatggcctttgtg

SEQ ID NO: 304961 - DNA, 20 bp, Artificial Sequence
  Description of Artificial Sequence: Synthetic oligonucleotide
  Target: ATXN1; (+) strand; PAM type: YTN; PAM sequence: CTT
tgtgacaacccatgacagct

SEQ ID NO: 304962 - DNA, 20 bp, Artificial Sequence
  Description of Artificial Sequence: Synthetic oligonucleotide
  Target: ATXN1; (+) strand; PAM type: YTN; PAM sequence: TTT
gtgacaacccatgacagctg

SEQ ID NO: 304963 - DNA, 20 bp, Artificial Sequence
  Description of Artificial Sequence: Synthetic oligonucleotide
  Target: ATXN1; (+) strand; PAM type: YTN; PAM sequence: TTG
tgacaacccatgacagctga

SEQ ID NO: 304964 - DNA, 20 bp, Artificial Sequence
  Description of Artificial Sequence: Synthetic oligonucleotide
  Target: ATXN1; (+) strand; PAM type: YTN; PAM sequence: CTG
agataggctctccggatggt

SEQ ID NO: 304965 - DNA, 20 bp, Artificial Sequence
  Description of Artificial Sequence: Synthetic oligonucleotide
  Target: ATXN1; (+) strand; PAM type: YTN; PAM sequence: CTC
tccggatggtcacatcccac

SEQ ID NO: 304966 - DNA, 20 bp, Artificial Sequence
  Description of Artificial Sequence: Synthetic oligonucleotide
  Target: ATXN1; (+) strand; PAM type: YTN; PAM sequence: CTC
cggatggtcacatcccacct

SEQ ID NO: 304967 - DNA, 20 bp, Artificial Sequence
  Description of Artificial Sequence: Synthetic oligonucleotide
  Target: ATXN1; (+) strand; PAM type: YTN; PAM sequence: CTG
tccttccttttccagcccct

SEQ ID NO: 304968 - DNA, 20 bp, Artificial Sequence
  Description of Artificial Sequence: Synthetic oligonucleotide
  Target: ATXN1; (+) strand; PAM type: YTN; PAM sequence: CTT
ccttttccagcccctgacat

SEQ ID NO: 304969 - DNA, 20 bp, Artificial Sequence
  Description of Artificial Sequence: Synthetic oligonucleotide
  Target: ATXN1; (+) strand; PAM type: YTN; PAM sequence: TTC
cttttccagcccctgacata

SEQ ID NO: 304970 - DNA, 20 bp, Artificial Sequence
  Description of Artificial Sequence: Synthetic oligonucleotide
  Target: ATXN1; (+) strand; PAM type: YTN; PAM sequence: CTT
ttccagcccctgacataaat

SEQ ID NO: 304971 - DNA, 20 bp, Artificial Sequence
  Description of Artificial Sequence: Synthetic oligonucleotide
  Target: ATXN1; (+) strand; PAM type: YTN; PAM sequence: TTT
tccagcccctgacataaatg

SEQ ID NO: 304972 - DNA, 20 bp, Artificial Sequence
  Description of Artificial Sequence: Synthetic oligonucleotide
  Target: ATXN1; (+) strand; PAM type: YTN; PAM sequence: TTT
ccagcccctgacataaatgt

SEQ ID NO: 304973 - DNA, 20 bp, Artificial Sequence
  Description of Artificial Sequence: Synthetic oligonucleotide
  Target: ATXN1; (+) strand; PAM type: YTN; PAM sequence: TTC
cagcccctgacataaatgtc

SEQ ID NO: 304974 - DNA, 20 bp, Artificial Sequence
  Description of Artificial Sequence: Synthetic oligonucleotide
  Target: ATXN1; (+) strand; PAM type: YTN; PAM sequence: CTG
acataaatgtcatggatttc

SEQ ID NO: 304975 - DNA, 20 bp, Artificial Sequence
  Description of Artificial Sequence: Synthetic oligonucleotide
  Target: ATXN1; (+) strand; PAM type: YTN; PAM sequence: TTT
cccgggtgggtcctaaatcc

SEQ ID NO: 304976 - DNA, 20 bp, Artificial Sequence
  Description of Artificial Sequence: Synthetic oligonucleotide
  Target: ATXN1; (+) strand; PAM type: YTN; PAM sequence: TTC
ccgggtgggtcctaaatcca

SEQ ID NO: 304977 - DNA, 20 bp, Artificial Sequence
  Description of Artificial Sequence: Synthetic oligonucleotide
  Target: ATXN1; (+) strand; PAM type: YTN; PAM sequence: CTA
aatccaatgaccactgttct

SEQ ID NO: 304978 - DNA, 20 bp, Artificial Sequence
  Description of Artificial Sequence: Synthetic oligonucleotide
  Target: ATXN1; (+) strand; PAM type: YTN; PAM sequence: CTG
ttcttctaagagacaggaga

SEQ ID NO: 304979 - DNA, 20 bp, Artificial Sequence
  Description of Artificial Sequence: Synthetic oligonucleotide
  Target: ATXN1; (+) strand; PAM type: YTN; PAM sequence: TTC
ttctaagagacaggagagga

SEQ ID NO: 304980 - DNA, 20 bp, Artificial Sequence
  Description of Artificial Sequence: Synthetic oligonucleotide
  Target: ATXN1; (+) strand; PAM type: YTN; PAM sequence: CTT
ctaagagacaggagaggacc

SEQ ID NO: 304981 - DNA, 20 bp, Artificial Sequence
  Description of Artificial Sequence: Synthetic oligonucleotide
  Target: ATXN1; (+) strand; PAM type: YTN; PAM sequence: TTC
taagagacaggagaggacct

SEQ ID NO: 304982 - DNA, 20 bp, Artificial Sequence
  Description of Artificial Sequence: Synthetic oligonucleotide
  Target: ATXN1; (+) strand; PAM type: YTN; PAM sequence: CTA
agagacaggagaggacctgg

SEQ ID NO: 304983 - DNA, 20 bp, Artificial Sequence
  Description of Artificial Sequence: Synthetic oligonucleotide
  Target: ATXN1; (+) strand; PAM type: YTN; PAM sequence: CTG
gtacagacacagaggagaag

SEQ ID NO: 304984 - DNA, 20 bp, Artificial Sequence
  Description of Artificial Sequence: Synthetic oligonucleotide
  Target: ATXN1; (+) strand; PAM type: YTN; PAM sequence: CTG
gagtgacgctgccacaagcc

SEQ ID NO: 304985 - DNA, 20 bp, Artificial Sequence
  Description of Artificial Sequence: Synthetic oligonucleotide
  Target: ATXN1; (+) strand; PAM type: YTN; PAM sequence: CTG
ccacaagccaaggaacgcct

SEQ ID NO: 304986 - DNA, 20 bp, Artificial Sequence
  Description of Artificial Sequence: Synthetic oligonucleotide
  Target: ATXN1; (+) strand; PAM type: YTN; PAM sequence: CTG
gaaccaccagaggatgacag

SEQ ID NO: 304987 - DNA, 20 bp, Artificial Sequence
  Description of Artificial Sequence: Synthetic oligonucleotide
  Target: ATXN1; (+) strand; PAM type: YTN; PAM sequence: TTC
tcccaacagagcttcgggag

SEQ ID NO: 304988 - DNA, 20 bp, Artificial Sequence
  Description of Artificial Sequence: Synthetic oligonucleotide
  Target: ATXN1; (+) strand; PAM type: YTN; PAM sequence: CTC
ccaacagagcttcgggaggg

SEQ ID NO: 304989 - DNA, 20 bp, Artificial Sequence
  Description of Artificial Sequence: Synthetic oligonucleotide
  Target: ATXN1; (+) strand; PAM type: YTN; PAM sequence: CTT
cgggagggagtgtggcccgg

SEQ ID NO: 304990 - DNA, 20 bp, Artificial Sequence
  Description of Artificial Sequence: Synthetic oligonucleotide
  Target: ATXN1; (+) strand; PAM type: YTN; PAM sequence: TTC
gggagggagtgtggcccggc

SEQ ID NO: 304991 - DNA, 20 bp, Artificial Sequence
  Description of Artificial Sequence: Synthetic oligonucleotide
  Target: ATXN1; (+) strand; PAM type: YTN; PAM sequence: CTG
acacctgatttcagacgtct

SEQ ID NO: 304992 - DNA, 20 bp, Artificial Sequence
  Description of Artificial Sequence: Synthetic oligonucleotide
  Target: ATXN1; (+) strand; PAM type: YTN; PAM sequence: CTG
atttcagacgtctgccctcc

SEQ ID NO: 304993 - DNA, 20 bp, Artificial Sequence
  Description of Artificial Sequence: Synthetic oligonucleotide
  Target: ATXN1; (+) strand; PAM type: YTN; PAM sequence: TTT
cagacgtctgccctccagaa

SEQ ID NO: 304994 - DNA, 20 bp, Artificial Sequence
  Description of Artificial Sequence: Synthetic oligonucleotide
  Target: ATXN1; (+) strand; PAM type: YTN; PAM sequence: TTC
agacgtctgccctccagaac

SEQ ID NO: 304995 - DNA, 20 bp, Artificial Sequence
  Description of Artificial Sequence: Synthetic oligonucleotide
  Target: ATXN1; (+) strand; PAM type: YTN; PAM sequence: CTG
ccctccagaactttgagaga

SEQ ID NO: 304996 - DNA, 20 bp, Artificial Sequence
  Description of Artificial Sequence: Synthetic oligonucleotide
  Target: ATXN1; (+) strand; PAM type: YTN; PAM sequence: CTC
cagaactttgagagaacaaa

SEQ ID NO: 304997 - DNA, 20 bp, Artificial Sequence
  Description of Artificial Sequence: Synthetic oligonucleotide
  Target: ATXN1; (+) strand; PAM type: YTN; PAM sequence: CTT
tgagagaacaaattcctgtt

SEQ ID NO: 304998 - DNA, 20 bp, Artificial Sequence
  Description of Artificial Sequence: Synthetic oligonucleotide
  Target: ATXN1; (+) strand; PAM type: YTN; PAM sequence: TTT
gagagaacaaattcctgttg

SEQ ID NO: 304999 - DNA, 20 bp, Artificial Sequence
  Description of Artificial Sequence: Synthetic oligonucleotide
  Target: ATXN1; (+) strand; PAM type: YTN; PAM sequence: TTG
agagaacaaattcctgttgt

SEQ ID NO: 305000 - DNA, 20 bp, Artificial Sequence
  Description of Artificial Sequence: Synthetic oligonucleotide
  Target: ATXN1; (+) strand; PAM type: YTN; PAM sequence: TTC
ctgttgttttaacccaccaa

SEQ ID NO: 305001 - DNA, 20 bp, Artificial Sequence
  Description of Artificial Sequence: Synthetic oligonucleotide
  Target: ATXN1; (+) strand; PAM type: YTN; PAM sequence: CTG
ttgttttaacccaccaagtt

SEQ ID NO: 305002 - DNA, 20 bp, Artificial Sequence
  Description of Artificial Sequence: Synthetic oligonucleotide
  Target: ATXN1; (+) strand; PAM type: YTN; PAM sequence: TTG
ttttaacccaccaagtttct

SEQ ID NO: 305003 - DNA, 20 bp, Artificial Sequence
  Description of Artificial Sequence: Synthetic oligonucleotide
  Target: ATXN1; (+) strand; PAM type: YTN; PAM sequence: TTT
taacccaccaagtttctggt

SEQ ID NO: 305004 - DNA, 20 bp, Artificial Sequence
  Description of Artificial Sequence: Synthetic oligonucleotide
  Target: ATXN1; (+) strand; PAM type: YTN; PAM sequence: TTT
aacccaccaagtttctggta

SEQ ID NO: 305005 - DNA, 20 bp, Artificial Sequence
  Description of Artificial Sequence: Synthetic oligonucleotide
  Target: ATXN1; (+) strand; PAM type: YTN; PAM sequence: TTA
acccaccaagtttctggtaa

SEQ ID NO: 305006 - DNA, 20 bp, Artificial Sequence
  Description of Artificial Sequence: Synthetic oligonucleotide
  Target: ATXN1; (+) strand; PAM type: YTN; PAM sequence: TTT
ctggtaatttattagagcag

SEQ ID NO: 305007 - DNA, 20 bp, Artificial Sequence
  Description of Artificial Sequence: Synthetic oligonucleotide
  Target: ATXN1; (+) strand; PAM type: YTN; PAM sequence: TTC
tggtaatttattagagcagc

SEQ ID NO: 305008 - DNA, 20 bp, Artificial Sequence
  Description of Artificial Sequence: Synthetic oligonucleotide
  Target: ATXN1; (+) strand; PAM type: YTN; PAM sequence: CTG
gtaatttattagagcagccc

SEQ ID NO: 305009 - DNA, 20 bp, Artificial Sequence
  Description of Artificial Sequence: Synthetic oligonucleotide
  Target: ATXN1; (+) strand; PAM type: YTN; PAM sequence: TTT
attagagcagccctggaaaa

SEQ ID NO: 305010 - DNA, 20 bp, Artificial Sequence
  Description of Artificial Sequence: Synthetic oligonucleotide
  Target: ATXN1; (+) strand; PAM type: YTN; PAM sequence: TTA
ttagagcagccctggaaaac

SEQ ID NO: 305011 - DNA, 20 bp, Artificial Sequence
  Description of Artificial Sequence: Synthetic oligonucleotide
  Target: ATXN1; (+) strand; PAM type: YTN; PAM sequence: TTA
gagcagccctggaaaactaa

SEQ ID NO: 305012 - DNA, 20 bp, Artificial Sequence
  Description of Artificial Sequence: Synthetic oligonucleotide
  Target: ATXN1; (+) strand; PAM type: YTN; PAM sequence: CTG
gaaaactaacagagtttccc

SEQ ID NO: 305013 - DNA, 20 bp, Artificial Sequence
  Description of Artificial Sequence: Synthetic oligonucleotide
  Target: ATXN1; (+) strand; PAM type: YTN; PAM sequence: CTA
acagagtttcccatcacatt

SEQ ID NO: 305014 - DNA, 20 bp, Artificial Sequence
  Description of Artificial Sequence: Synthetic oligonucleotide
  Target: ATXN1; (+) strand; PAM type: YTN; PAM sequence: TTT
cccatcacatttagcgtaaa

SEQ ID NO: 305015 - DNA, 20 bp, Artificial Sequence
  Description of Artificial Sequence: Synthetic oligonucleotide
  Target: ATXN1; (+) strand; PAM type: YTN; PAM sequence: TTC
ccatcacatttagcgtaaaa

SEQ ID NO: 305016 - DNA, 20 bp, Artificial Sequence
  Description of Artificial Sequence: Synthetic oligonucleotide
  Target: ATXN1; (+) strand; PAM type: YTN; PAM sequence: TTT
agcgtaaaatccaagctcct

SEQ ID NO: 305017 - DNA, 20 bp, Artificial Sequence
  Description of Artificial Sequence: Synthetic oligonucleotide
  Target: ATXN1; (+) strand; PAM type: YTN; PAM sequence: TTA
gcgtaaaatccaagctcctg

SEQ ID NO: 305018 - DNA, 20 bp, Artificial Sequence
  Description of Artificial Sequence: Synthetic oligonucleotide
  Target: ATXN1; (+) strand; PAM type: YTN; PAM sequence: CTC
ctgcagcctctagatcaatt

SEQ ID NO: 305019 - DNA, 20 bp, Artificial Sequence
  Description of Artificial Sequence: Synthetic oligonucleotide
  Target: ATXN1; (+) strand; PAM type: YTN; PAM sequence: CTG
cagcctctagatcaattcaa

SEQ ID NO: 305020 - DNA, 20 bp, Artificial Sequence
  Description of Artificial Sequence: Synthetic oligonucleotide
  Target: ATXN1; (+) strand; PAM type: YTN; PAM sequence: CTC
tagatcaattcaaaggctcc

SEQ ID NO: 305021 - DNA, 20 bp, Artificial Sequence
  Description of Artificial Sequence: Synthetic oligonucleotide
  Target: ATXN1; (+) strand; PAM type: YTN; PAM sequence: CTA
gatcaattcaaaggctcctt

SEQ ID NO: 305022 - DNA, 20 bp, Artificial Sequence
  Description of Artificial Sequence: Synthetic oligonucleotide
  Target: ATXN1; (+) strand; PAM type: YTN; PAM sequence: TTC
aaaggctccttctggcctca

SEQ ID NO: 305023 - DNA, 20 bp, Artificial Sequence
  Description of Artificial Sequence: Synthetic oligonucleotide
  Target: ATXN1; (+) strand; PAM type: YTN; PAM sequence: CTC
cttctggcctcagagccttc

SEQ ID NO: 305024 - DNA, 20 bp, Artificial Sequence
  Description of Artificial Sequence: Synthetic oligonucleotide
  Target: ATXN1; (+) strand; PAM type: YTN; PAM sequence: CTT
ctggcctcagagccttcacc

SEQ ID NO: 305025 - DNA, 20 bp, Artificial Sequence
  Description of Artificial Sequence: Synthetic oligonucleotide
  Target: ATXN1; (+) strand; PAM type: YTN; PAM sequence: TTC
tggcctcagagccttcacct

SEQ ID NO: 305026 - DNA, 20 bp, Artificial Sequence
  Description of Artificial Sequence: Synthetic oligonucleotide
  Target: ATXN1; (+) strand; PAM type: YTN; PAM sequence: CTG
gcctcagagccttcacctgg

SEQ ID NO: 305027 - DNA, 20 bp, Artificial Sequence
  Description of Artificial Sequence: Synthetic oligonucleotide
  Target: ATXN1; (+) strand; PAM type: YTN; PAM sequence: CTC
agagccttcacctggccatt

SEQ ID NO: 305028 - DNA, 20 bp, Artificial Sequence
  Description of Artificial Sequence: Synthetic oligonucleotide
  Target: ATXN1; (+) strand; PAM type: YTN; PAM sequence: CTT
cacctggccattctcttcct

SEQ ID NO: 305029 - DNA, 20 bp, Artificial Sequence
  Description of Artificial Sequence: Synthetic oligonucleotide
  Target: ATXN1; (+) strand; PAM type: YTN; PAM sequence: TTC
acctggccattctcttcctt

SEQ ID NO: 305030 - DNA, 20 bp, Artificial Sequence
  Description of Artificial Sequence: Synthetic oligonucleotide
  Target: ATXN1; (+) strand; PAM type: YTN; PAM sequence: CTG
gccattctcttcctttacag

SEQ ID NO: 305031 - DNA, 20 bp, Artificial Sequence
  Description of Artificial Sequence: Synthetic oligonucleotide
  Target: ATXN1; (+) strand; PAM type: YTN; PAM sequence: TTC
tcttcctttacagtgctcat

SEQ ID NO: 305032 - DNA, 20 bp, Artificial Sequence
  Description of Artificial Sequence: Synthetic oligonucleotide
  Target: ATXN1; (+) strand; PAM type: YTN; PAM sequence: CTC
ttcctttacagtgctcatcc

SEQ ID NO: 305033 - DNA, 20 bp, Artificial Sequence
  Description of Artificial Sequence: Synthetic oligonucleotide
  Target: ATXN1; (+) strand; PAM type: YTN; PAM sequence: CTT
cctttacagtgctcatcctc

SEQ ID NO: 305034 - DNA, 20 bp, Artificial Sequence
  Description of Artificial Sequence: Synthetic oligonucleotide
  Target: ATXN1; (+) strand; PAM type: YTN; PAM sequence: TTC
ctttacagtgctcatcctca

SEQ ID NO: 305035 - DNA, 20 bp, Artificial Sequence
  Description of Artificial Sequence: Synthetic oligonucleotide
  Target: ATXN1; (+) strand; PAM type: YTN; PAM sequence: CTT
tacagtgctcatcctcagat

SEQ ID NO: 305036 - DNA, 20 bp, Artificial Sequence
  Description of Artificial Sequence: Synthetic oligonucleotide
  Target: ATXN1; (+) strand; PAM type: YTN; PAM sequence: TTT
acagtgctcatcctcagatt

SEQ ID NO: 305037 - DNA, 20 bp, Artificial Sequence
  Description of Artificial Sequence: Synthetic oligonucleotide
  Target: ATXN1; (+) strand; PAM type: YTN; PAM sequence: TTA
cagtgctcatcctcagattc

SEQ ID NO: 305038 - DNA, 20 bp, Artificial Sequence
  Description of Artificial Sequence: Synthetic oligonucleotide
  Target: ATXN1; (+) strand; PAM type: YTN; PAM sequence: CTC
atcctcagattctcatctca

SEQ ID NO: 305039 - DNA, 20 bp, Artificial Sequence
  Description of Artificial Sequence: Synthetic oligonucleotide
  Target: ATXN1; (+) strand; PAM type: YTN; PAM sequence: CTC
agattctcatctcacccttc

SEQ ID NO: 305040 - DNA, 20 bp, Artificial Sequence
  Description of Artificial Sequence: Synthetic oligonucleotide
  Target: ATXN1; (+) strand; PAM type: YTN; PAM sequence: TTC
tcatctcacccttcaccact

SEQ ID NO: 305041 - DNA, 20 bp, Artificial Sequence
  Description of Artificial Sequence: Synthetic oligonucleotide
  Target: ATXN1; (+) strand; PAM type: YTN; PAM sequence: CTC
atctcacccttcaccactcc

SEQ ID NO: 305042 - DNA, 20 bp, Artificial Sequence
  Description of Artificial Sequence: Synthetic oligonucleotide
  Target: ATXN1; (+) strand; PAM type: YTN; PAM sequence: CTC
acccttcaccactcccatct

SEQ ID NO: 305043 - DNA, 20 bp, Artificial Sequence
  Description of Artificial Sequence: Synthetic oligonucleotide
  Target: ATXN1; (+) strand; PAM type: YTN; PAM sequence: CTT
caccactcccatcttccagg

SEQ ID NO: 305044 - DNA, 20 bp, Artificial Sequence
  Description of Artificial Sequence: Synthetic oligonucleotide
  Target: ATXN1; (+) strand; PAM type: YTN; PAM sequence: TTC
accactcccatcttccaggg

SEQ ID NO: 305045 - DNA, 20 bp, Artificial Sequence
  Description of Artificial Sequence: Synthetic oligonucleotide
  Target: ATXN1; (+) strand; PAM type: YTN; PAM sequence: CTC
ccatcttccagggctggctc

SEQ ID NO: 305046 - DNA, 20 bp, Artificial Sequence
  Description of Artificial Sequence: Synthetic oligonucleotide
  Target: ATXN1; (+) strand; PAM type: YTN; PAM sequence: CTT
ccagggctggctcctatacc

SEQ ID NO: 305047 - DNA, 20 bp, Artificial Sequence
  Description of Artificial Sequence: Synthetic oligonucleotide
  Target: ATXN1; (+) strand; PAM type: YTN; PAM sequence: TTC
cagggctggctcctatacct

SEQ ID NO: 305048 - DNA, 20 bp, Artificial Sequence
  Description of Artificial Sequence: Synthetic oligonucleotide
  Target: ATXN1; (+) strand; PAM type: YTN; PAM sequence: CTG
gctcctataccttactgcag

SEQ ID NO: 305049 - DNA, 20 bp, Artificial Sequence
  Description of Artificial Sequence: Synthetic oligonucleotide
  Target: ATXN1; (+) strand; PAM type: YTN; PAM sequence: CTC
ctataccttactgcagtctc

SEQ ID NO: 305050 - DNA, 20 bp, Artificial Sequence
  Description of Artificial Sequence: Synthetic oligonucleotide
  Target: ATXN1; (+) strand; PAM type: YTN; PAM sequence: CTA
taccttactgcagtctctgt

SEQ ID NO: 305051 - DNA, 20 bp, Artificial Sequence
  Description of Artificial Sequence: Synthetic oligonucleotide
  Target: ATXN1; (+) strand; PAM type: YTN; PAM sequence: CTT
actgcagtctctgtacaaaa

SEQ ID NO: 305052 - DNA, 20 bp, Artificial Sequence
  Description of Artificial Sequence: Synthetic oligonucleotide
  Target: ATXN1; (+) strand; PAM type: YTN; PAM sequence: TTA
ctgcagtctctgtacaaaag

SEQ ID NO: 305053 - DNA, 20 bp, Artificial Sequence
  Description of Artificial Sequence: Synthetic oligonucleotide
  Target: ATXN1; (+) strand; PAM type: YTN; PAM sequence: CTG
cagtctctgtacaaaagccc

SEQ ID NO: 305054 - DNA, 20 bp, Artificial Sequence
  Description of Artificial Sequence: Synthetic oligonucleotide
  Target: ATXN1; (+) strand; PAM type: YTN; PAM sequence: CTC
tgtacaaaagcccatcccct

SEQ ID NO: 305055 - DNA, 20 bp, Artificial Sequence
  Description of Artificial Sequence: Synthetic oligonucleotide
  Target: ATXN1; (+) strand; PAM type: YTN; PAM sequence: CTG
tacaaaagcccatcccctaa

SEQ ID NO: 305056 - DNA, 20 bp, Artificial Sequence
  Description of Artificial Sequence: Synthetic oligonucleotide
  Target: ATXN1; (+) strand; PAM type: YTN; PAM sequence: CTA
agactttccctgactccacc

SEQ ID NO: 305057 - DNA, 20 bp, Artificial Sequence
  Description of Artificial Sequence: Synthetic oligonucleotide
  Target: ATXN1; (+) strand; PAM type: YTN; PAM sequence: CTT
tccctgactccaccaaacaa

SEQ ID NO: 305058 - DNA, 20 bp, Artificial Sequence
  Description of Artificial Sequence: Synthetic oligonucleotide
  Target: ATXN1; (+) strand; PAM type: YTN; PAM sequence: TTT
ccctgactccaccaaacaaa

SEQ ID NO: 305059 - DNA, 20 bp, Artificial Sequence
  Description of Artificial Sequence: Synthetic oligonucleotide
  Target: ATXN1; (+) strand; PAM type: YTN; PAM sequence: TTC
cctgactccaccaaacaaaa

SEQ ID NO: 305060 - DNA, 20 bp, Artificial Sequence
  Description of Artificial Sequence: Synthetic oligonucleotide
  Target: ATXN1; (+) strand; PAM type: YTN; PAM sequence: CTG
actccaccaaacaaaagaat

SEQ ID NO: 305061 - DNA, 20 bp, Artificial Sequence
  Description of Artificial Sequence: Synthetic oligonucleotide
  Target: ATXN1; (+) strand; PAM type: YTN; PAM sequence: CTC
caccaaacaaaagaatcccc

SEQ ID NO: 305062 - DNA, 20 bp, Artificial Sequence
  Description of Artificial Sequence: Synthetic oligonucleotide
  Target: ATXN1; (+) strand; PAM type: YTN; PAM sequence: CTT
cgcccctgccatcactcttt

SEQ ID NO: 305063 - DNA, 20 bp, Artificial Sequence
  Description of Artificial Sequence: Synthetic oligonucleotide
  Target: ATXN1; (+) strand; PAM type: YTN; PAM sequence: TTC
gcccctgccatcactctttc

SEQ ID NO: 305064 - DNA, 20 bp, Artificial Sequence
  Description of Artificial Sequence: Synthetic oligonucleotide
  Target: ATXN1; (+) strand; PAM type: YTN; PAM sequence: CTG
ccatcactctttctcctaac

SEQ ID NO: 305065 - DNA, 20 bp, Artificial Sequence
  Description of Artificial Sequence: Synthetic oligonucleotide
  Target: ATXN1; (+) strand; PAM type: YTN; PAM sequence: CTC
tttctcctaacatatcctac

SEQ ID NO: 305066 - DNA, 20 bp, Artificial Sequence
  Description of Artificial Sequence: Synthetic oligonucleotide
  Target: ATXN1; (+) strand; PAM type: YTN; PAM sequence: CTT
tctcctaacatatcctactc

SEQ ID NO: 305067 - DNA, 20 bp, Artificial Sequence
  Description of Artificial Sequence: Synthetic oligonucleotide
  Target: ATXN1; (+) strand; PAM type: YTN; PAM sequence: TTT
ctcctaacatatcctactct

SEQ ID NO: 305068 - DNA, 20 bp, Artificial Sequence
  Description of Artificial Sequence: Synthetic oligonucleotide
  Target: ATXN1; (+) strand; PAM type: YTN; PAM sequence: TTC
tcctaacatatcctactcta

SEQ ID NO: 305069 - DNA, 20 bp, Artificial Sequence
  Description of Artificial Sequence: Synthetic oligonucleotide
  Target: ATXN1; (+) strand; PAM type: YTN; PAM sequence: CTC
ctaacatatcctactctatt

SEQ ID NO: 305070 - DNA, 20 bp, Artificial Sequence
  Description of Artificial Sequence: Synthetic oligonucleotide
  Target: ATXN1; (+) strand; PAM type: YTN; PAM sequence: CTA
acatatcctactctattttg

SEQ ID NO: 305071 - DNA, 20 bp, Artificial Sequence
  Description of Artificial Sequence: Synthetic oligonucleotide
  Target: ATXN1; (+) strand; PAM type: YTN; PAM sequence: CTA
ctctattttggggggtctgc

SEQ ID NO: 305072 - DNA, 20 bp, Artificial Sequence
  Description of Artificial Sequence: Synthetic oligonucleotide
  Target: ATXN1; (+) strand; PAM type: YTN; PAM sequence: CTC
tattttggggggtctgcaaa

SEQ ID NO: 305073 - DNA, 20 bp, Artificial Sequence
  Description of Artificial Sequence: Synthetic oligonucleotide
  Target: ATXN1; (+) strand; PAM type: YTN; PAM sequence: CTA
ttttggggggtctgcaaata

SEQ ID NO: 305074 - DNA, 20 bp, Artificial Sequence
  Description of Artificial Sequence: Synthetic oligonucleotide
  Target: ATXN1; (+) strand; PAM type: YTN; PAM sequence: TTT
tggggggtctgcaaatagag

SEQ ID NO: 305075 - DNA, 20 bp, Artificial Sequence
  Description of Artificial Sequence: Synthetic oligonucleotide
  Target: ATXN1; (+) strand; PAM type: YTN; PAM sequence: TTT
ggggggtctgcaaatagagt

SEQ ID NO: 305076 - DNA, 20 bp, Artificial Sequence
  Description of Artificial Sequence: Synthetic oligonucleotide
  Target: ATXN1; (+) strand; PAM type: YTN; PAM sequence: TTG
gggggtctgcaaatagagtc

SEQ ID NO: 305077 - DNA, 20 bp, Artificial Sequence
  Description of Artificial Sequence: Synthetic oligonucleotide
  Target: ATXN1; (+) strand; PAM type: YTN; PAM sequence: CTG
caaatagagtctacttatgc

SEQ ID NO: 305078 - DNA, 20 bp, Artificial Sequence
  Description of Artificial Sequence: Synthetic oligonucleotide
  Target: ATXN1; (+) strand; PAM type: YTN; PAM sequence: CTA
cttatgcaatttacttgtgg

SEQ ID NO: 305079 - DNA, 20 bp, Artificial Sequence
  Description of Artificial Sequence: Synthetic oligonucleotide
  Target: ATXN1; (+) strand; PAM type: YTN; PAM sequence: CTT
atgcaatttacttgtggttg

SEQ ID NO: 305080 - DNA, 20 bp, Artificial Sequence
  Description of Artificial Sequence: Synthetic oligonucleotide
  Target: ATXN1; (+) strand; PAM type: YTN; PAM sequence: TTA
tgcaatttacttgtggttgt

SEQ ID NO: 305081 - DNA, 20 bp, Artificial Sequence
  Description of Artificial Sequence: Synthetic oligonucleotide
  Target: ATXN1; (+) strand; PAM type: YTN; PAM sequence: TTT
acttgtggttgtctccacta

SEQ ID NO: 305082 - DNA, 20 bp, Artificial Sequence
  Description of Artificial Sequence: Synthetic oligonucleotide
  Target: ATXN1; (+) strand; PAM type: YTN; PAM sequence: TTA
cttgtggttgtctccactat

SEQ ID NO: 305083 - DNA, 20 bp, Artificial Sequence
  Description of Artificial Sequence: Synthetic oligonucleotide
  Target: ATXN1; (+) strand; PAM type: YTN; PAM sequence: CTT
gtggttgtctccactatgag

SEQ ID NO: 305084 - DNA, 20 bp, Artificial Sequence
  Description of Artificial Sequence: Synthetic oligonucleotide
  Target: ATXN1; (+) strand; PAM type: YTN; PAM sequence: TTG
tggttgtctccactatgaga

SEQ ID NO: 305085 - DNA, 20 bp, Artificial Sequence
  Description of Artificial Sequence: Synthetic oligonucleotide
  Target: ATXN1; (+) strand; PAM type: YTN; PAM sequence: TTG
tctccactatgagaacataa

SEQ ID NO: 305086 - DNA, 20 bp, Artificial Sequence
  Description of Artificial Sequence: Synthetic oligonucleotide
  Target: ATXN1; (+) strand; PAM type: YTN; PAM sequence: CTC
cactatgagaacataagctc

SEQ ID NO: 305087 - DNA, 20 bp, Artificial Sequence
  Description of Artificial Sequence: Synthetic oligonucleotide
  Target: ATXN1; (+) strand; PAM type: YTN; PAM sequence: CTA
tgagaacataagctctctga

SEQ ID NO: 305088 - DNA, 20 bp, Artificial Sequence
  Description of Artificial Sequence: Synthetic oligonucleotide
  Target: ATXN1; (+) strand; PAM type: YTN; PAM sequence: CTC
tctgagggcagggacttaga

SEQ ID NO: 305089 - DNA, 20 bp, Artificial Sequence
  Description of Artificial Sequence: Synthetic oligonucleotide
  Target: ATXN1; (+) strand; PAM type: YTN; PAM sequence: CTC
tgagggcagggacttagaca

SEQ ID NO: 305090 - DNA, 20 bp, Artificial Sequence
  Description of Artificial Sequence: Synthetic oligonucleotide
  Target: ATXN1; (+) strand; PAM type: YTN; PAM sequence: CTG
agggcagggacttagacaac

SEQ ID NO: 305091 - DNA, 20 bp, Artificial Sequence
  Description of Artificial Sequence: Synthetic oligonucleotide
  Target: ATXN1; (+) strand; PAM type: YTN; PAM sequence: CTT
agacaaccttgtttgttctc

SEQ ID NO: 305092 - DNA, 20 bp, Artificial Sequence
  Description of Artificial Sequence: Synthetic oligonucleotide
  Target: ATXN1; (+) strand; PAM type: YTN; PAM sequence: TTA
gacaaccttgtttgttctct

SEQ ID NO: 305093 - DNA, 20 bp, Artificial Sequence
  Description of Artificial Sequence: Synthetic oligonucleotide
  Target: ATXN1; (+) strand; PAM type: YTN; PAM sequence: CTT
gtttgttctctgttacgtcc

SEQ ID NO: 305094 - DNA, 20 bp, Artificial Sequence
  Description of Artificial Sequence: Synthetic oligonucleotide
  Target: ATXN1; (+) strand; PAM type: YTN; PAM sequence: TTG
tttgttctctgttacgtcct

SEQ ID NO: 305095 - DNA, 20 bp, Artificial Sequence
  Description of Artificial Sequence: Synthetic oligonucleotide
  Target: ATXN1; (+) strand; PAM type: YTN; PAM sequence: TTT
gttctctgttacgtcctcag

SEQ ID NO: 305096 - DNA, 20 bp, Artificial Sequence
  Description of Artificial Sequence: Synthetic oligonucleotide
  Target: ATXN1; (+) strand; PAM type: YTN; PAM sequence: TTG
ttctctgttacgtcctcagt

SEQ ID NO: 305097 - DNA, 20 bp, Artificial Sequence
  Description of Artificial Sequence: Synthetic oligonucleotide
  Target: ATXN1; (+) strand; PAM type: YTN; PAM sequence: TTC
tctgttacgtcctcagtgca

SEQ ID NO: 305098 - DNA, 20 bp, Artificial Sequence
  Description of Artificial Sequence: Synthetic oligonucleotide
  Target: ATXN1; (+) strand; PAM type: YTN; PAM sequence: CTC
tgttacgtcctcagtgcata

SEQ ID NO: 305099 - DNA, 20 bp, Artificial Sequence
  Description of Artificial Sequence: Synthetic oligonucleotide
  Target: ATXN1; (+) strand; PAM type: YTN; PAM sequence: CTG
ttacgtcctcagtgcataca

SEQ ID NO: 305100 - DNA, 20 bp, Artificial Sequence
  Description of Artificial Sequence: Synthetic oligonucleotide
  Target: ATXN1; (+) strand; PAM type: YTN; PAM sequence: TTA
cgtcctcagtgcatacaacc

SEQ ID NO: 305101 - DNA, 20 bp, Artificial Sequence
  Description of Artificial Sequence: Synthetic oligonucleotide
  Target: ATXN1; (+) strand; PAM type: YTN; PAM sequence: CTC
agtgcatacaaccatgtctg

SEQ ID NO: 305102 - DNA, 20 bp, Artificial Sequence
  Description of Artificial Sequence: Synthetic oligonucleotide
  Target: ATXN1; (+) strand; PAM type: YTN; PAM sequence: CTG
gtgcagaaaagacattcaat

SEQ ID NO: 305103 - DNA, 20 bp, Artificial Sequence
  Description of Artificial Sequence: Synthetic oligonucleotide
  Target: ATXN1; (+) strand; PAM type: YTN; PAM sequence: TTC
aataaatacttggttgtata

SEQ ID NO: 305104 - DNA, 20 bp, Artificial Sequence
  Description of Artificial Sequence: Synthetic oligonucleotide
  Target: ATXN1; (+) strand; PAM type: YTN; PAM sequence: CTT
ggttgtataagaatgaataa

SEQ ID NO: 305105 - DNA, 20 bp, Artificial Sequence
  Description of Artificial Sequence: Synthetic oligonucleotide
  Target: ATXN1; (+) strand; PAM type: YTN; PAM sequence: TTG
gttgtataagaatgaataaa

SEQ ID NO: 305106 - DNA, 20 bp, Artificial Sequence
  Description of Artificial Sequence: Synthetic oligonucleotide
  Target: ATXN1; (+) strand; PAM type: YTN; PAM sequence: TTG
tataagaatgaataaattat

SEQ ID NO: 305107 - DNA, 20 bp, Artificial Sequence
  Description of Artificial Sequence: Synthetic oligonucleotide
  Target: ATXN1; (+) strand; PAM type: YTN; PAM sequence: TTA
tttttctgtgctttcactca

SEQ ID NO: 305108 - DNA, 20 bp, Artificial Sequence
  Description of Artificial Sequence: Synthetic oligonucleotide
  Target: ATXN1; (+) strand; PAM type: YTN; PAM sequence: TTT
ttctgtgctttcactcaatt

SEQ ID NO: 305109 - DNA, 20 bp, Artificial Sequence
  Description of Artificial Sequence: Synthetic oligonucleotide
  Target: ATXN1; (+) strand; PAM type: YTN; PAM sequence: TTT
tctgtgctttcactcaatta

SEQ ID NO: 305110 - DNA, 20 bp, Artificial Sequence
  Description of Artificial Sequence: Synthetic oligonucleotide
  Target: ATXN1; (+) strand; PAM type: YTN; PAM sequence: TTT
ctgtgctttcactcaattat

SEQ ID NO: 305111 - DNA, 20 bp, Artificial Sequence
  Description of Artificial Sequence: Synthetic oligonucleotide
  Target: ATXN1; (+) strand; PAM type: YTN; PAM sequence: TTC
tgtgctttcactcaattata

SEQ ID NO: 305112 - DNA, 20 bp, Artificial Sequence
  Description of Artificial Sequence: Synthetic oligonucleotide
  Target: ATXN1; (+) strand; PAM type: YTN; PAM sequence: CTG
tgctttcactcaattataaa

SEQ ID NO: 305113 - DNA, 20 bp, Artificial Sequence
  Description of Artificial Sequence: Synthetic oligonucleotide
  Target: ATXN1; (+) strand; PAM type: YTN; PAM sequence: CTT
tcactcaattataaaagcct

SEQ ID NO: 305114 - DNA, 20 bp, Artificial Sequence
  Description of Artificial Sequence: Synthetic oligonucleotide
  Target: ATXN1; (+) strand; PAM type: YTN; PAM sequence: TTT
cactcaattataaaagcctg

SEQ ID NO: 305115 - DNA, 20 bp, Artificial Sequence
  Description of Artificial Sequence: Synthetic oligonucleotide
  Target: ATXN1; (+) strand; PAM type: YTN; PAM sequence: TTC
actcaattataaaagcctga

SEQ ID NO: 305116 - DNA, 20 bp, Artificial Sequence
  Description of Artificial Sequence: Synthetic oligonucleotide
  Target: ATXN1; (+) strand; PAM type: YTN; PAM sequence: CTC
aattataaaagcctgacttg

SEQ ID NO: 305117 - DNA, 20 bp, Artificial Sequence
  Description of Artificial Sequence: Synthetic oligonucleotide
  Target: ATXN1; (+) strand; PAM type: YTN; PAM sequence: TTA
taaaagcctgacttgattag

SEQ ID NO: 305118 - DNA, 20 bp, Artificial Sequence
  Description of Artificial Sequence: Synthetic oligonucleotide
  Target: ATXN1; (+) strand; PAM type: YTN; PAM sequence: CTG
acttgattagcaccatcaag

SEQ ID NO: 305119 - DNA, 20 bp, Artificial Sequence
  Description of Artificial Sequence: Synthetic oligonucleotide
  Target: ATXN1; (+) strand; PAM type: YTN; PAM sequence: CTT
gattagcaccatcaagacat

SEQ ID NO: 305120 - DNA, 20 bp, Artificial Sequence
  Description of Artificial Sequence: Synthetic oligonucleotide
  Target: ATXN1; (+) strand; PAM type: YTN; PAM sequence: TTG
attagcaccatcaagacata

SEQ ID NO: 305121 - DNA, 20 bp, Artificial Sequence
  Description of Artificial Sequence: Synthetic oligonucleotide
  Target: ATXN1; (+) strand; PAM type: YTN; PAM sequence: TTA
gcaccatcaagacatatgag

SEQ ID NO: 305122 - DNA, 20 bp, Artificial Sequence
  Description of Artificial Sequence: Synthetic oligonucleotide
  Target: ATXN1; (+) strand; PAM type: YTN; PAM sequence: CTT
aagacattctctgcattgca

SEQ ID NO: 305123 - DNA, 20 bp, Artificial Sequence
  Description of Artificial Sequence: Synthetic oligonucleotide
  Target: ATXN1; (+) strand; PAM type: YTN; PAM sequence: TTA
agacattctctgcattgcaa

SEQ ID NO: 305124 - DNA, 20 bp, Artificial Sequence
  Description of Artificial Sequence: Synthetic oligonucleotide
  Target: ATXN1; (+) strand; PAM type: YTN; PAM sequence: TTC
tctgcattgcaagtcaagaa

SEQ ID NO: 305125 - DNA, 20 bp, Artificial Sequence
  Description of Artificial Sequence: Synthetic oligonucleotide
  Target: ATXN1; (+) strand; PAM type: YTN; PAM sequence: CTC
tgcattgcaagtcaagaatg

SEQ ID NO: 305126 - DNA, 20 bp, Artificial Sequence
  Description of Artificial Sequence: Synthetic oligonucleotide
  Target: ATXN1; (+) strand; PAM type: YTN; PAM sequence: CTG
cattgcaagtcaagaatgct

SEQ ID NO: 305127 - DNA, 20 bp, Artificial Sequence
  Description of Artificial Sequence: Synthetic oligonucleotide
  Target: ATXN1; (+) strand; PAM type: YTN; PAM sequence: TTG
caagtcaagaatgcttacta

SEQ ID NO: 305128 - DNA, 20 bp, Artificial Sequence
  Description of Artificial Sequence: Synthetic oligonucleotide
  Target: ATXN1; (+) strand; PAM type: YTN; PAM sequence: CTT
actattatttttgaaaatat

SEQ ID NO: 305129 - DNA, 20 bp, Artificial Sequence
  Description of Artificial Sequence: Synthetic oligonucleotide
  Target: ATXN1; (+) strand; PAM type: YTN; PAM sequence: TTA
ctattatttttgaaaatatc

SEQ ID NO: 305130 - DNA, 20 bp, Artificial Sequence
  Description of Artificial Sequence: Synthetic oligonucleotide
  Target: ATXN1; (+) strand; PAM type: YTN; PAM sequence: CTA
ttatttttgaaaatatctga

SEQ ID NO: 305131 - DNA, 20 bp, Artificial Sequence
  Description of Artificial Sequence: Synthetic oligonucleotide
  Target: ATXN1; (+) strand; PAM type: YTN; PAM sequence: TTA
tttttgaaaatatctgaggg

SEQ ID NO: 305132 - DNA, 20 bp, Artificial Sequence
  Description of Artificial Sequence: Synthetic oligonucleotide
  Target: ATXN1; (+) strand; PAM type: YTN; PAM sequence: TTT
ttgaaaatatctgagggttt

SEQ ID NO: 305133 - DNA, 20 bp, Artificial Sequence
  Description of Artificial Sequence: Synthetic oligonucleotide
  Target: ATXN1; (+) strand; PAM type: YTN; PAM sequence: TTT
tgaaaatatctgagggttta

SEQ ID NO: 305134 - DNA, 20 bp, Artificial Sequence
  Description of Artificial Sequence: Synthetic oligonucleotide
  Target: ATXN1; (+) strand; PAM type: YTN; PAM sequence: TTT
gaaaatatctgagggtttac

SEQ ID NO: 305135 - DNA, 20 bp, Artificial Sequence
  Description of Artificial Sequence: Synthetic oligonucleotide
  Target: ATXN1; (+) strand; PAM type: YTN; PAM sequence: TTG
aaaatatctgagggtttaca

SEQ ID NO: 305136 - DNA, 20 bp, Artificial Sequence
  Description of Artificial Sequence: Synthetic oligonucleotide
  Target: ATXN1; (+) strand; PAM type: YTN; PAM sequence: CTG
agggtttacaacctctctcc

SEQ ID NO: 305137 - DNA, 20 bp, Artificial Sequence
  Description of Artificial Sequence: Synthetic oligonucleotide
  Target: ATXN1; (+) strand; PAM type: YTN; PAM sequence: TTT
acaacctctctccaatgctc

SEQ ID NO: 305138 - DNA, 20 bp, Artificial Sequence
  Description of Artificial Sequence: Synthetic oligonucleotide
  Target: ATXN1; (+) strand; PAM type: YTN; PAM sequence: TTA
caacctctctccaatgctct

SEQ ID NO: 305139 - DNA, 20 bp, Artificial Sequence
  Description of Artificial Sequence: Synthetic oligonucleotide
  Target: ATXN1; (+) strand; PAM type: YTN; PAM sequence: CTC
tctccaatgctcttctatta

SEQ ID NO: 305140 - DNA, 20 bp, Artificial Sequence
  Description of Artificial Sequence: Synthetic oligonucleotide
  Target: ATXN1; (+) strand; PAM type: YTN; PAM sequence: CTC
tccaatgctcttctattaaa

SEQ ID NO: 305141 - DNA, 20 bp, Artificial Sequence
  Description of Artificial Sequence: Synthetic oligonucleotide
  Target: ATXN1; (+) strand; PAM type: YTN; PAM sequence: CTC
caatgctcttctattaaaac

SEQ ID NO: 305142 - DNA, 20 bp, Artificial Sequence
  Description of Artificial Sequence: Synthetic oligonucleotide
  Target: ATXN1; (+) strand; PAM type: YTN; PAM sequence: CTC
ttctattaaaactcagttga

SEQ ID NO: 305143 - DNA, 20 bp, Artificial Sequence
  Description of Artificial Sequence: Synthetic oligonucleotide
  Target: ATXN1; (+) strand; PAM type: YTN; PAM sequence: CTT
ctattaaaactcagttgatc

SEQ ID NO: 305144 - DNA, 20 bp, Artificial Sequence
  Description of Artificial Sequence: Synthetic oligonucleotide
  Target: ATXN1; (+) strand; PAM type: YTN; PAM sequence: TTC
tattaaaactcagttgatcc

SEQ ID NO: 305145 - DNA, 20 bp, Artificial Sequence
  Description of Artificial Sequence: Synthetic oligonucleotide
  Target: ATXN1; (+) strand; PAM type: YTN; PAM sequence: CTA
ttaaaactcagttgatccaa

SEQ ID NO: 305146 - DNA, 20 bp, Artificial Sequence
  Description of Artificial Sequence: Synthetic oligonucleotide
  Target: ATXN1; (+) strand; PAM type: YTN; PAM sequence: TTA
aaactcagttgatccaaaca

SEQ ID NO: 305147 - DNA, 20 bp, Artificial Sequence
  Description of Artificial Sequence: Synthetic oligonucleotide
  Target: ATXN1; (+) strand; PAM type: YTN; PAM sequence: CTC
agttgatccaaacatggctt

SEQ ID NO: 305148 - DNA, 20 bp, Artificial Sequence
  Description of Artificial Sequence: Synthetic oligonucleotide
  Target: ATXN1; (+) strand; PAM type: YTN; PAM sequence: TTG
atccaaacatggcttttttg

SEQ ID NO: 305149 - DNA, 20 bp, Artificial Sequence
  Description of Artificial Sequence: Synthetic oligonucleotide
  Target: ATXN1; (+) strand; PAM type: YTN; PAM sequence: CTT
ttttgcttttattatttggg

SEQ ID NO: 305150 - DNA, 20 bp, Artificial Sequence
  Description of Artificial Sequence: Synthetic oligonucleotide
  Target: ATXN1; (+) strand; PAM type: YTN; PAM sequence: TTT
tttgcttttattatttgggt

SEQ ID NO: 305151 - DNA, 20 bp, Artificial Sequence
  Description of Artificial Sequence: Synthetic oligonucleotide
  Target: ATXN1; (+) strand; PAM type: YTN; PAM sequence: TTT
ttgcttttattatttgggtc

SEQ ID NO: 305152 - DNA, 20 bp, Artificial Sequence
  Description of Artificial Sequence: Synthetic oligonucleotide
  Target: ATXN1; (+) strand; PAM type: YTN; PAM sequence: TTT
tgcttttattatttgggtcg

SEQ ID NO: 305153 - DNA, 20 bp, Artificial Sequence
  Description of Artificial Sequence: Synthetic oligonucleotide
  Target: ATXN1; (+) strand; PAM type: YTN; PAM sequence: TTT
gcttttattatttgggtcga

SEQ ID NO: 305154 - DNA, 20 bp, Artificial Sequence
  Description of Artificial Sequence: Synthetic oligonucleotide
  Target: ATXN1; (+) strand; PAM type: YTN; PAM sequence: TTG
cttttattatttgggtcgag

SEQ ID NO: 305155 - DNA, 20 bp, Artificial Sequence
  Description of Artificial Sequence: Synthetic oligonucleotide
  Target: ATXN1; (+) strand; PAM type: YTN; PAM sequence: CTT
ttattatttgggtcgagcta

SEQ ID NO: 305156 - DNA, 20 bp, Artificial Sequence
  Description of Artificial Sequence: Synthetic oligonucleotide
  Target: ATXN1; (+) strand; PAM type: YTN; PAM sequence: TTT
tattatttgggtcgagctaa

SEQ ID NO: 305157 - DNA, 20 bp, Artificial Sequence
  Description of Artificial Sequence: Synthetic oligonucleotide
  Target: ATXN1; (+) strand; PAM type: YTN; PAM sequence: TTT
attatttgggtcgagctaaa

SEQ ID NO: 305158 - DNA, 20 bp, Artificial Sequence
  Description of Artificial Sequence: Synthetic oligonucleotide
  Target: ATXN1; (+) strand; PAM type: YTN; PAM sequence: TTA
ttatttgggtcgagctaaag

SEQ ID NO: 305159 - DNA, 20 bp, Artificial Sequence
  Description of Artificial Sequence: Synthetic oligonucleotide
  Target: ATXN1; (+) strand; PAM type: YTN; PAM sequence: TTA
tttgggtcgagctaaagcat

SEQ ID NO: 305160 - DNA, 20 bp, Artificial Sequence
  Description of Artificial Sequence: Synthetic oligonucleotide
  Target: ATXN1; (+) strand; PAM type: YTN; PAM sequence: TTT
gggtcgagctaaagcatggt

SEQ ID NO: 305161 - DNA, 20 bp, Artificial Sequence
  Description of Artificial Sequence: Synthetic oligonucleotide
  Target: ATXN1; (+) strand; PAM type: YTN; PAM sequence: TTG
ggtcgagctaaagcatggta

SEQ ID NO: 305162 - DNA, 20 bp, Artificial Sequence
  Description of Artificial Sequence: Synthetic oligonucleotide
  Target: ATXN1; (+) strand; PAM type: YTN; PAM sequence: CTA
aagcatggtataaaggagag

SEQ ID NO: 305163 - DNA, 20 bp, Artificial Sequence
  Description of Artificial Sequence: Synthetic oligonucleotide
  Target: ATXN1; (+) strand; PAM type: YTN; PAM sequence: CTA
aatccttttcctaccagcta

SEQ ID NO: 305164 - DNA, 20 bp, Artificial Sequence
  Description of Artificial Sequence: Synthetic oligonucleotide
  Target: ATXN1; (+) strand; PAM type: YTN; PAM sequence: CTT
ttcctaccagctatgtgagc

SEQ ID NO: 305165 - DNA, 20 bp, Artificial Sequence
  Description of Artificial Sequence: Synthetic oligonucleotide
  Target: ATXN1; (+) strand; PAM type: YTN; PAM sequence: TTT
tcctaccagctatgtgagcc

SEQ ID NO: 305166 - DNA, 20 bp, Artificial Sequence
  Description of Artificial Sequence: Synthetic oligonucleotide
  Target: ATXN1; (+) strand; PAM type: YTN; PAM sequence: TTT
cctaccagctatgtgagcct

SEQ ID NO: 305167 - DNA, 20 bp, Artificial Sequence
  Description of Artificial Sequence: Synthetic oligonucleotide
  Target: ATXN1; (+) strand; PAM type: YTN; PAM sequence: TTC
ctaccagctatgtgagcctg

SEQ ID NO: 305168 - DNA, 20 bp, Artificial Sequence
  Description of Artificial Sequence: Synthetic oligonucleotide
  Target: ATXN1; (+) strand; PAM type: YTN; PAM sequence: CTA
ccagctatgtgagcctgagt

SEQ ID NO: 305169 - DNA, 20 bp, Artificial Sequence
  Description of Artificial Sequence: Synthetic oligonucleotide
  Target: ATXN1; (+) strand; PAM type: YTN; PAM sequence: CTA
tgtgagcctgagtaagtaat

SEQ ID NO: 305170 - DNA, 20 bp, Artificial Sequence
  Description of Artificial Sequence: Synthetic oligonucleotide
  Target: ATXN1; (+) strand; PAM type: YTN; PAM sequence: CTG
agtaagtaattaccctcttt

SEQ ID NO: 305171 - DNA, 20 bp, Artificial Sequence
  Description of Artificial Sequence: Synthetic oligonucleotide
  Target: ATXN1; (+) strand; PAM type: YTN; PAM sequence: TTA
ccctctttgagcctgtagaa

SEQ ID NO: 305172 - DNA, 20 bp, Artificial Sequence
  Description of Artificial Sequence: Synthetic oligonucleotide
  Target: ATXN1; (+) strand; PAM type: YTN; PAM sequence: CTC
tttgagcctgtagaaaagaa

SEQ ID NO: 305173 - DNA, 20 bp, Artificial Sequence
  Description of Artificial Sequence: Synthetic oligonucleotide
  Target: ATXN1; (+) strand; PAM type: YTN; PAM sequence: CTT
tgagcctgtagaaaagaatg

SEQ ID NO: 305174 - DNA, 20 bp, Artificial Sequence
  Description of Artificial Sequence: Synthetic oligonucleotide
  Target: ATXN1; (+) strand; PAM type: YTN; PAM sequence: TTT
gagcctgtagaaaagaatga

SEQ ID NO: 305175 - DNA, 20 bp, Artificial Sequence
  Description of Artificial Sequence: Synthetic oligonucleotide
  Target: ATXN1; (+) strand; PAM type: YTN; PAM sequence: TTG
agcctgtagaaaagaatgat

SEQ ID NO: 305176 - DNA, 20 bp, Artificial Sequence
  Description of Artificial Sequence: Synthetic oligonucleotide
  Target: ATXN1; (+) strand; PAM type: YTN; PAM sequence: CTG
tagaaaagaatgataaaaca

SEQ ID NO: 305177 - DNA, 20 bp, Artificial Sequence
  Description of Artificial Sequence: Synthetic oligonucleotide
  Target: ATXN1; (+) strand; PAM type: YTN; PAM sequence: CTG
tgtctatatccacagggctg

SEQ ID NO: 305178 - DNA, 20 bp, Artificial Sequence
  Description of Artificial Sequence: Synthetic oligonucleotide
  Target: ATXN1; (+) strand; PAM type: YTN; PAM sequence: CTA
tatccacagggctgctatga

SEQ ID NO: 305179 - DNA, 20 bp, Artificial Sequence
  Description of Artificial Sequence: Synthetic oligonucleotide
  Target: ATXN1; (+) strand; PAM type: YTN; PAM sequence: CTG
ctatgagaacccattgaggt

SEQ ID NO: 305180 - DNA, 20 bp, Artificial Sequence
  Description of Artificial Sequence: Synthetic oligonucleotide
  Target: ATXN1; (+) strand; PAM type: YTN; PAM sequence: CTA
tgagaacccattgaggtaac

SEQ ID NO: 305181 - DNA, 20 bp, Artificial Sequence
  Description of Artificial Sequence: Synthetic oligonucleotide
  Target: ATXN1; (+) strand; PAM type: YTN; PAM sequence: TTG
aggtaacccatccagcaaaa

SEQ ID NO: 305182 - DNA, 20 bp, Artificial Sequence
  Description of Artificial Sequence: Synthetic oligonucleotide
  Target: ATXN1; (+) strand; PAM type: YTN; PAM sequence: TTT
ctttagatgctgttcaggcc

SEQ ID NO: 305183 - DNA, 20 bp, Artificial Sequence
  Description of Artificial Sequence: Synthetic oligonucleotide
  Target: ATXN1; (+) strand; PAM type: YTN; PAM sequence: TTC
tttagatgctgttcaggcca

SEQ ID NO: 305184 - DNA, 20 bp, Artificial Sequence
  Description of Artificial Sequence: Synthetic oligonucleotide
  Target: ATXN1; (+) strand; PAM type: YTN; PAM sequence: CTT
tagatgctgttcaggccaga

SEQ ID NO: 305185 - DNA, 20 bp, Artificial Sequence
  Description of Artificial Sequence: Synthetic oligonucleotide
  Target: ATXN1; (+) strand; PAM type: YTN; PAM sequence: TTT
agatgctgttcaggccagat

SEQ ID NO: 305186 - DNA, 20 bp, Artificial Sequence
  Description of Artificial Sequence: Synthetic oligonucleotide
  Target: ATXN1; (+) strand; PAM type: YTN; PAM sequence: TTA
gatgctgttcaggccagata

SEQ ID NO: 305187 - DNA, 20 bp, Artificial Sequence
  Description of Artificial Sequence: Synthetic oligonucleotide
  Target: ATXN1; (+) strand; PAM type: YTN; PAM sequence: CTG
ttcaggccagatactgtgct

SEQ ID NO: 305188 - DNA, 20 bp, Artificial Sequence
  Description of Artificial Sequence: Synthetic oligonucleotide
  Target: ATXN1; (+) strand; PAM type: YTN; PAM sequence: TTC
aggccagatactgtgctagc

SEQ ID NO: 305189 - DNA, 20 bp, Artificial Sequence
  Description of Artificial Sequence: Synthetic oligonucleotide
  Target: ATXN1; (+) strand; PAM type: YTN; PAM sequence: CTG
tgctagcagtgacacagtta

SEQ ID NO: 305190 - DNA, 20 bp, Artificial Sequence
  Description of Artificial Sequence: Synthetic oligonucleotide
  Target: ATXN1; (+) strand; PAM type: YTN; PAM sequence: CTA
gcagtgacacagttagaacc

SEQ ID NO: 305191 - DNA, 20 bp, Artificial Sequence
  Description of Artificial Sequence: Synthetic oligonucleotide
  Target: ATXN1; (+) strand; PAM type: YTN; PAM sequence: TTA
gaacccaggcaagaaatgtc

SEQ ID NO: 305192 - DNA, 20 bp, Artificial Sequence
  Description of Artificial Sequence: Synthetic oligonucleotide
  Target: ATXN1; (+) strand; PAM type: YTN; PAM sequence: CTG
tccttatcaagcatacctct

SEQ ID NO: 305193 - DNA, 20 bp, Artificial Sequence
  Description of Artificial Sequence: Synthetic oligonucleotide
  Target: ATXN1; (+) strand; PAM type: YTN; PAM sequence: CTT
atcaagcatacctctaggca

SEQ ID NO: 305194 - DNA, 20 bp, Artificial Sequence
  Description of Artificial Sequence: Synthetic oligonucleotide
  Target: ATXN1; (+) strand; PAM type: YTN; PAM sequence: TTA
tcaagcatacctctaggcac

SEQ ID NO: 305195 - DNA, 20 bp, Artificial Sequence
  Description of Artificial Sequence: Synthetic oligonucleotide
  Target: ATXN1; (+) strand; PAM type: YTN; PAM sequence: CTC
taggcacattttgcaaactg

SEQ ID NO: 305196 - DNA, 20 bp, Artificial Sequence
  Description of Artificial Sequence: Synthetic oligonucleotide
  Target: ATXN1; (+) strand; PAM type: YTN; PAM sequence: CTA
ggcacattttgcaaactgtc

SEQ ID NO: 305197 - DNA, 20 bp, Artificial Sequence
  Description of Artificial Sequence: Synthetic oligonucleotide
  Target: ATXN1; (+) strand; PAM type: YTN; PAM sequence: TTT
tgcaaactgtcaagacttgt

SEQ ID NO: 305198 - DNA, 20 bp, Artificial Sequence
  Description of Artificial Sequence: Synthetic oligonucleotide
  Target: ATXN1; (+) strand; PAM type: YTN; PAM sequence: TTT
gcaaactgtcaagacttgtg

SEQ ID NO: 305199 - DNA, 20 bp, Artificial Sequence
  Description of Artificial Sequence: Synthetic oligonucleotide
  Target: ATXN1; (+) strand; PAM type: YTN; PAM sequence: TTG
caaactgtcaagacttgtgc

SEQ ID NO: 305200 - DNA, 20 bp, Artificial Sequence
  Description of Artificial Sequence: Synthetic oligonucleotide
  Target: ATXN1; (+) strand; PAM type: YTN; PAM sequence: CTG
tcaagacttgtgcagatgta

SEQ ID NO: 305201 - DNA, 20 bp, Artificial Sequence
  Description of Artificial Sequence: Synthetic oligonucleotide
  Target: ATXN1; (+) strand; PAM type: YTN; PAM sequence: CTT
gtgcagatgtaatggaatct

SEQ ID NO: 305202 - DNA, 20 bp, Artificial Sequence
  Description of Artificial Sequence: Synthetic oligonucleotide
  Target: ATXN1; (+) strand; PAM type: YTN; PAM sequence: TTG
tgcagatgtaatggaatctg

SEQ ID NO: 305203 - DNA, 20 bp, Artificial Sequence
  Description of Artificial Sequence: Synthetic oligonucleotide
  Target: ATXN1; (+) strand; PAM type: YTN; PAM sequence: CTG
agatttgtgcttgacacacc

SEQ ID NO: 305204 - DNA, 20 bp, Artificial Sequence
  Description of Artificial Sequence: Synthetic oligonucleotide
  Target: ATXN1; (+) strand; PAM type: YTN; PAM sequence: TTT
gtgcttgacacacccagagg

SEQ ID NO: 305205 - DNA, 20 bp, Artificial Sequence
  Description of Artificial Sequence: Synthetic oligonucleotide
  Target: ATXN1; (+) strand; PAM type: YTN; PAM sequence: TTG
tgcttgacacacccagagga

SEQ ID NO: 305206 - DNA, 20 bp, Artificial Sequence
  Description of Artificial Sequence: Synthetic oligonucleotide
  Target: ATXN1; (+) strand; PAM type: YTN; PAM sequence: CTT
gacacacccagaggataacc

SEQ ID NO: 305207 - DNA, 20 bp, Artificial Sequence
  Description of Artificial Sequence: Synthetic oligonucleotide
  Target: ATXN1; (+) strand; PAM type: YTN; PAM sequence: TTG
acacacccagaggataacca

SEQ ID NO: 305208 - DNA, 20 bp, Artificial Sequence
  Description of Artificial Sequence: Synthetic oligonucleotide
  Target: ATXN1; (+) strand; PAM type: YTN; PAM sequence: CTC
ccccgttccaaattattcct

SEQ ID NO: 305209 - DNA, 20 bp, Artificial Sequence
  Description of Artificial Sequence: Synthetic oligonucleotide
  Target: ATXN1; (+) strand; PAM type: YTN; PAM sequence: TTC
caaattattcctgctctgca

SEQ ID NO: 305210 - DNA, 20 bp, Artificial Sequence
  Description of Artificial Sequence: Synthetic oligonucleotide
  Target: ATXN1; (+) strand; PAM type: YTN; PAM sequence: TTA
ttcctgctctgcatacctat

SEQ ID NO: 305211 - DNA, 20 bp, Artificial Sequence
  Description of Artificial Sequence: Synthetic oligonucleotide
  Target: ATXN1; (+) strand; PAM type: YTN; PAM sequence: TTC
ctgctctgcatacctattaa

SEQ ID NO: 305212 - DNA, 20 bp, Artificial Sequence
  Description of Artificial Sequence: Synthetic oligonucleotide
  Target: ATXN1; (+) strand; PAM type: YTN; PAM sequence: CTG
ctctgcatacctattaatac

SEQ ID NO: 305213 - DNA, 20 bp, Artificial Sequence
  Description of Artificial Sequence: Synthetic oligonucleotide
  Target: ATXN1; (+) strand; PAM type: YTN; PAM sequence: CTC
tgcatacctattaatacaaa

SEQ ID NO: 305214 - DNA, 20 bp, Artificial Sequence
  Description of Artificial Sequence: Synthetic oligonucleotide
  Target: ATXN1; (+) strand; PAM type: YTN; PAM sequence: CTG
catacctattaatacaaatg

SEQ ID NO: 305215 - DNA, 20 bp, Artificial Sequence
  Description of Artificial Sequence: Synthetic oligonucleotide
  Target: ATXN1; (+) strand; PAM type: YTN; PAM sequence: CTA
ttaatacaaatgcaaaccag

SEQ ID NO: 305216 - DNA, 20 bp, Artificial Sequence
  Description of Artificial Sequence: Synthetic oligonucleotide
  Target: ATXN1; (+) strand; PAM type: YTN; PAM sequence: TTA
atacaaatgcaaaccagaag

SEQ ID NO: 305217 - DNA, 20 bp, Artificial Sequence
  Description of Artificial Sequence: Synthetic oligonucleotide
  Target: ATXN1; (+) strand; PAM type: YTN; PAM sequence: TTC
ccttaagacagctattagtt

SEQ ID NO: 305218 - DNA, 20 bp, Artificial Sequence
  Description of Artificial Sequence: Synthetic oligonucleotide
  Target: ATXN1; (+) strand; PAM type: YTN; PAM sequence: CTT
aagacagctattagttttta

SEQ ID NO: 305219 - DNA, 20 bp, Artificial Sequence
  Description of Artificial Sequence: Synthetic oligonucleotide
  Target: ATXN1; (+) strand; PAM type: YTN; PAM sequence: TTA
agacagctattagtttttac

SEQ ID NO: 305220 - DNA, 20 bp, Artificial Sequence
  Description of Artificial Sequence: Synthetic oligonucleotide
  Target: ATXN1; (+) strand; PAM type: YTN; PAM sequence: CTA
ttagtttttactcaattact

SEQ ID NO: 305221 - DNA, 20 bp, Artificial Sequence
  Description of Artificial Sequence: Synthetic oligonucleotide
  Target: ATXN1; (+) strand; PAM type: YTN; PAM sequence: TTA
gtttttactcaattactcac

SEQ ID NO: 305222 - DNA, 20 bp, Artificial Sequence
  Description of Artificial Sequence: Synthetic oligonucleotide
  Target: ATXN1; (+) strand; PAM type: YTN; PAM sequence: TTT
ttactcaattactcacacat

SEQ ID NO: 305223 - DNA, 20 bp, Artificial Sequence
  Description of Artificial Sequence: Synthetic oligonucleotide
  Target: ATXN1; (+) strand; PAM type: YTN; PAM sequence: TTT
tactcaattactcacacatt

SEQ ID NO: 305224 - DNA, 20 bp, Artificial Sequence
  Description of Artificial Sequence: Synthetic oligonucleotide
  Target: ATXN1; (+) strand; PAM type: YTN; PAM sequence: TTT
actcaattactcacacattt

SEQ ID NO: 305225 - DNA, 20 bp, Artificial Sequence
  Description of Artificial Sequence: Synthetic oligonucleotide
  Target: ATXN1; (+) strand; PAM type: YTN; PAM sequence: TTA
ctcaattactcacacatttc

SEQ ID NO: 305226 - DNA, 20 bp, Artificial Sequence
  Description of Artificial Sequence: Synthetic oligonucleotide
  Target: ATXN1; (+) strand; PAM type: YTN; PAM sequence: CTC
aattactcacacatttcccc

SEQ ID NO: 305227 - DNA, 20 bp, Artificial Sequence
  Description of Artificial Sequence: Synthetic oligonucleotide
  Target: ATXN1; (+) strand; PAM type: YTN; PAM sequence: TTA
ctcacacatttccccaaatg

SEQ ID NO: 305228 - DNA, 20 bp, Artificial Sequence
  Description of Artificial Sequence: Synthetic oligonucleotide
  Target: ATXN1; (+) strand; PAM type: YTN; PAM sequence: CTC
acacatttccccaaatgttc

SEQ ID NO: 305229 - DNA, 20 bp, Artificial Sequence
  Description of Artificial Sequence: Synthetic oligonucleotide
  Target: ATXN1; (+) strand; PAM type: YTN; PAM sequence: TTT
ccccaaatgttcctcatttg

SEQ ID NO: 305230 - DNA, 20 bp, Artificial Sequence
  Description of Artificial Sequence: Synthetic oligonucleotide
  Target: ATXN1; (+) strand; PAM type: YTN; PAM sequence: TTC
cccaaatgttcctcatttgt

SEQ ID NO: 305231 - DNA, 20 bp, Artificial Sequence
  Description of Artificial Sequence: Synthetic oligonucleotide
  Target: ATXN1; (+) strand; PAM type: YTN; PAM sequence: TTC
ctcatttgtctcatgccgag

SEQ ID NO: 305232 - DNA, 20 bp, Artificial Sequence
  Description of Artificial Sequence: Synthetic oligonucleotide
  Target: ATXN1; (+) strand; PAM type: YTN; PAM sequence: CTC
atttgtctcatgccgagcaa

SEQ ID NO: 305233 - DNA, 20 bp, Artificial Sequence
  Description of Artificial Sequence: Synthetic oligonucleotide
  Target: ATXN1; (+) strand; PAM type: YTN; PAM sequence: TTT
gtctcatgccgagcaatttc

SEQ ID NO: 305234 - DNA, 20 bp, Artificial Sequence
  Description of Artificial Sequence: Synthetic oligonucleotide
  Target: ATXN1; (+) strand; PAM type: YTN; PAM sequence: TTG
tctcatgccgagcaatttct

SEQ ID NO: 305235 - DNA, 20 bp, Artificial Sequence
  Description of Artificial Sequence: Synthetic oligonucleotide
  Target: ATXN1; (+) strand; PAM type: YTN; PAM sequence: CTC
atgccgagcaatttctaata

SEQ ID NO: 305236 - DNA, 20 bp, Artificial Sequence
  Description of Artificial Sequence: Synthetic oligonucleotide
  Target: ATXN1; (+) strand; PAM type: YTN; PAM sequence: TTT
ctaatacagataaaaatcag

SEQ ID NO: 305237 - DNA, 20 bp, Artificial Sequence
  Description of Artificial Sequence: Synthetic oligonucleotide
  Target: ATXN1; (+) strand; PAM type: YTN; PAM sequence: TTC
taatacagataaaaatcagg

SEQ ID NO: 305238 - DNA, 20 bp, Artificial Sequence
  Description of Artificial Sequence: Synthetic oligonucleotide
  Target: ATXN1; (+) strand; PAM type: YTN; PAM sequence: CTA
atacagataaaaatcaggag

SEQ ID NO: 305239 - DNA, 20 bp, Artificial Sequence
  Description of Artificial Sequence: Synthetic oligonucleotide
  Target: ATXN1; (+) strand; PAM type: YTN; PAM sequence: CTA
ctacgaacaaggttacggca

SEQ ID NO: 305240 - DNA, 20 bp, Artificial Sequence
  Description of Artificial Sequence: Synthetic oligonucleotide
  Target: ATXN1; (+) strand; PAM type: YTN; PAM sequence: CTA
cgaacaaggttacggcatgt

SEQ ID NO: 305241 - DNA, 20 bp, Artificial Sequence
  Description of Artificial Sequence: Synthetic oligonucleotide
  Target: ATXN1; (+) strand; PAM type: YTN; PAM sequence: TTA
cggcatgtagccatcccaaa

SEQ ID NO: 305242 - DNA, 20 bp, Artificial Sequence
  Description of Artificial Sequence: Synthetic oligonucleotide
  Target: ATXN1; (+) strand; PAM type: YTN; PAM sequence: CTG
aaacattattccttttcatt

SEQ ID NO: 305243 - DNA, 20 bp, Artificial Sequence
  Description of Artificial Sequence: Synthetic oligonucleotide
  Target: ATXN1; (+) strand; PAM type: YTN; PAM sequence: TTA
ttccttttcattatttcaaa

SEQ ID NO: 305244 - DNA, 20 bp, Artificial Sequence
  Description of Artificial Sequence: Synthetic oligonucleotide
  Target: ATXN1; (+) strand; PAM type: YTN; PAM sequence: TTC
cttttcattatttcaaaaga

SEQ ID NO: 305245 - DNA, 20 bp, Artificial Sequence
  Description of Artificial Sequence: Synthetic oligonucleotide
  Target: ATXN1; (+) strand; PAM type: YTN; PAM sequence: CTT
ttcattatttcaaaagaaac

SEQ ID NO: 305246 - DNA, 20 bp, Artificial Sequence
  Description of Artificial Sequence: Synthetic oligonucleotide
  Target: ATXN1; (+) strand; PAM type: YTN; PAM sequence: TTT
tcattatttcaaaagaaaca

SEQ ID NO: 305247 - DNA, 20 bp, Artificial Sequence
  Description of Artificial Sequence: Synthetic oligonucleotide
  Target: ATXN1; (+) strand; PAM type: YTN; PAM sequence: TTT
cattatttcaaaagaaacaa

SEQ ID NO: 305248 - DNA, 20 bp, Artificial Sequence
  Description of Artificial Sequence: Synthetic oligonucleotide
  Target: ATXN1; (+) strand; PAM type: YTN; PAM sequence: TTC
attatttcaaaagaaacaaa

SEQ ID NO: 305249 - DNA, 20 bp, Artificial Sequence
  Description of Artificial Sequence: Synthetic oligonucleotide
  Target: ATXN1; (+) strand; PAM type: YTN; PAM sequence: TTA
tttcaaaagaaacaaaccac

SEQ ID NO: 305250 - DNA, 20 bp, Artificial Sequence
  Description of Artificial Sequence: Synthetic oligonucleotide
  Target: ATXN1; (+) strand; PAM type: YTN; PAM sequence: TTT
caaaagaaacaaaccacatt

SEQ ID NO: 305251 - DNA, 20 bp, Artificial Sequence
  Description of Artificial Sequence: Synthetic oligonucleotide
  Target: ATXN1; (+) strand; PAM type: YTN; PAM sequence: TTC
aaaagaaacaaaccacattt

SEQ ID NO: 305252 - DNA, 20 bp, Artificial Sequence
  Description of Artificial Sequence: Synthetic oligonucleotide
  Target: ATXN1; (+) strand; PAM type: YTN; PAM sequence: TTT
gaaatatgtaccaagtggct

SEQ ID NO: 305253 - DNA, 20 bp, Artificial Sequence
  Description of Artificial Sequence: Synthetic oligonucleotide
  Target: ATXN1; (+) strand; PAM type: YTN; PAM sequence: TTG
aaatatgtaccaagtggctg

SEQ ID NO: 305254 - DNA, 20 bp, Artificial Sequence
  Description of Artificial Sequence: Synthetic oligonucleotide
  Target: ATXN1; (+) strand; PAM type: YTN; PAM sequence: CTG
ggggtggttgttcatgccta

SEQ ID NO: 305255 - DNA, 20 bp, Artificial Sequence
  Description of Artificial Sequence: Synthetic oligonucleotide
  Target: ATXN1; (+) strand; PAM type: YTN; PAM sequence: TTG
ttcatgcctataatcccagc

SEQ ID NO: 305256 - DNA, 20 bp, Artificial Sequence
  Description of Artificial Sequence: Synthetic oligonucleotide
  Target: ATXN1; (+) strand; PAM type: YTN; PAM sequence: TTC
atgcctataatcccagcact

SEQ ID NO: 305257 - DNA, 20 bp, Artificial Sequence
  Description of Artificial Sequence: Synthetic oligonucleotide
  Target: ATXN1; (+) strand; PAM type: YTN; PAM sequence: CTA
taatcccagcactttgggag

SEQ ID NO: 305258 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggtgggagg

SEQ ID NO: 305259 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggtgggagga

SEQ ID NO: 305260 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggaggac

SEQ ID NO: 305261 - DNA, 20 bp, Artificial Sequence
  Description of Artificial Sequence: Synthetic oligonucleotide
  Target: ATXN1; (+) strand; PAM type: YTN; PAM sequence: CTG
aggtgggaggactgcttgag

SEQ ID NO: 305262 - DNA, 20 bp, Artificial Sequence
  Description of Artificial Sequence: Synthetic oligonucleotide
  Target: ATXN1; (+) strand; PAM type: YTN; PAM sequence: CTG
cttgaggccagggagttcga

SEQ ID NO: 305263 - DNA, 20 bp, Artificial Sequence
  Description of Artificial Sequence: Synthetic oligonucleotide
  Target: ATXN1; (+) strand; PAM type: YTN; PAM sequence: CTT
gaggccagggagttcgagac

SEQ ID NO: 305264 - DNA, 20 bp, Artificial Sequence
  Description of Artificial Sequence: Synthetic oligonucleotide
  Target: ATXN1; (+) strand; PAM type: YTN; PAM sequence: TTG
aggccagggagttcgagacc

SEQ ID NO: 305265 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgggcaacat

SEQ ID NO: 305266 - DNA, 20 bp, Artificial Sequence
  Description of Artificial Sequence: Synthetic oligonucleotide
  Target: ATXN1; (+) strand; PAM type: YTN; PAM sequence: CTG
ggcaacatagtgagacctcg

SEQ ID NO: 305267 - DNA, 20 bp, Artificial Sequence
  Description of Artificial Sequence: Synthetic oligonucleotide
  Target: ATXN1; (+) strand; PAM type: YTN; PAM sequence: CTC
gtctctacaaaaaatttgaa

SEQ ID NO: 305268 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaatttgaaaatga

SEQ ID NO: 305269 - DNA, 20 bp, Artificial Sequence
  Description of Artificial Sequence: Synthetic oligonucleotide
  Target: ATXN1; (+) strand; PAM type: YTN; PAM sequence: CTA
caaaaaatttgaaaatgagc

SEQ ID NO: 305270 - DNA, 20 bp, Artificial Sequence
  Description of Artificial Sequence: Synthetic oligonucleotide
  Target: ATXN1; (+) strand; PAM type: YTN; PAM sequence: TTT
gaaaatgagccagctatggt

SEQ ID NO: 305271 - DNA, 20 bp, Artificial Sequence
  Description of Artificial Sequence: Synthetic oligonucleotide
  Target: ATXN1; (+) strand; PAM type: YTN; PAM sequence: TTG
aaaatgagccagctatggtg

SEQ ID NO: 305272 - DNA, 20 bp, Artificial Sequence
  Description of Artificial Sequence: Synthetic oligonucleotide
  Target: ATXN1; (+) strand; PAM type: YTN; PAM sequence: CTA
tggtggcacgtccttgtagt

SEQ ID NO: 305273 - DNA, 20 bp, Artificial Sequence
  Description of Artificial Sequence: Synthetic oligonucleotide
  Target: ATXN1; (+) strand; PAM type: YTN; PAM sequence: CTT
gtagttctagatattcggga

SEQ ID NO: 305274 - DNA, 20 bp, Artificial Sequence
  Description of Artificial Sequence: Synthetic oligonucleotide
  Target: ATXN1; (+) strand; PAM type: YTN; PAM sequence: TTG
tagttctagatattcgggag

SEQ ID NO: 305275 - DNA, 20 bp, Artificial Sequence
  Description of Artificial Sequence: Synthetic oligonucleotide
  Target: ATXN1; (+) strand; PAM type: YTN; PAM sequence: TTC
tagatattcgggaggctgga

SEQ ID NO: 305276 - DNA, 20 bp, Artificial Sequence
  Description of Artificial Sequence: Synthetic oligonucleotide
  Target: ATXN1; (+) strand; PAM type: YTN; PAM sequence: CTA
gatattcgggaggctggaac

SEQ ID NO: 305277 - DNA, 20 bp, Artificial Sequence
  Description of Artificial Sequence: Synthetic oligonucleotide
  Target: ATXN1; (+) strand; PAM type: YTN; PAM sequence: TTC
gggaggctggaacaagagga

SEQ ID NO: 305278 - DNA, 20 bp, Artificial Sequence
  Description of Artificial Sequence: Synthetic oligonucleotide
  Target: ATXN1; (+) strand; PAM type: YTN; PAM sequence: CTG
gaacaagaggactgcttgag

SEQ ID NO: 305279 - DNA, 20 bp, Artificial Sequence
  Description of Artificial Sequence: Synthetic oligonucleotide
  Target: ATXN1; (+) strand; PAM type: YTN; PAM sequence: CTG
cttgagcccgggtatttgag

SEQ ID NO: 305280 - DNA, 20 bp, Artificial Sequence
  Description of Artificial Sequence: Synthetic oligonucleotide
  Target: ATXN1; (+) strand; PAM type: YTN; PAM sequence: CTT
gagcccgggtatttgaggct

SEQ ID NO: 305281 - DNA, 20 bp, Artificial Sequence
  Description of Artificial Sequence: Synthetic oligonucleotide
  Target: ATXN1; (+) strand; PAM type: YTN; PAM sequence: TTG
agcccgggtatttgaggctg

SEQ ID NO: 305282 - DNA, 20 bp, Artificial Sequence
  Description of Artificial Sequence: Synthetic oligonucleotide
  Target: ATXN1; (+) strand; PAM type: YTN; PAM sequence: TTT
gaggctgcagtgagctatga

SEQ ID NO: 305283 - DNA, 20 bp, Artificial Sequence
  Description of Artificial Sequence: Synthetic oligonucleotide
  Target: ATXN1; (+) strand; PAM type: YTN; PAM sequence: TTG
aggctgcagtgagctatgat

SEQ ID NO: 305284 - DNA, 20 bp, Artificial Sequence
  Description of Artificial Sequence: Synthetic oligonucleotide
  Target: ATXN1; (+) strand; PAM type: YTN; PAM sequence: CTG
cagtgagctatgatcatgcc

SEQ ID NO: 305285 - DNA, 20 bp, Artificial Sequence
  Description of Artificial Sequence: Synthetic oligonucleotide
  Target: ATXN1; (+) strand; PAM type: YTN; PAM sequence: CTA
tgatcatgccactgcactcc

SEQ ID NO: 305286 - DNA, 20 bp, Artificial Sequence
  Description of Artificial Sequence: Synthetic oligonucleotide
  Target: ATXN1; (+) strand; PAM type: YTN; PAM sequence: CTG
cactccagccagggtgatag

SEQ ID NO: 305287 - DNA, 20 bp, Artificial Sequence
  Description of Artificial Sequence: Synthetic oligonucleotide
  Target: ATXN1; (+) strand; PAM type: YTN; PAM sequence: CTC
cagccagggtgatagaggga

SEQ ID NO: 305288 - DNA, 20 bp, Artificial Sequence
  Description of Artificial Sequence: Synthetic oligonucleotide
  Target: ATXN1; (+) strand; PAM type: YTN; PAM sequence: CTG
cctcttaaaaaataaataaa

SEQ ID NO: 305289 - DNA, 20 bp, Artificial Sequence
  Description of Artificial Sequence: Synthetic oligonucleotide
  Target: ATXN1; (+) strand; PAM type: YTN; PAM sequence: CTC
ttaaaaaataaataaataaa

SEQ ID NO: 305290 - DNA, 20 bp, Artificial Sequence
  Description of Artificial Sequence: Synthetic oligonucleotide
  Target: ATXN1; (+) strand; PAM type: YTN; PAM sequence: CTT
aaaaaataaataaataaata

SEQ ID NO: 305291 - DNA, 20 bp, Artificial Sequence
  Description of Artificial Sequence: Synthetic oligonucleotide
  Target: ATXN1; (+) strand; PAM type: YTN; PAM sequence: TTA
aaaaataaataaataaatac

SEQ ID NO: 305292 - DNA, 20 bp, Artificial Sequence
  Description of Artificial Sequence: Synthetic oligonucleotide
  Target: ATXN1; (+) strand; PAM type: YTN; PAM sequence: CTG
caatgcagatttaatgtaat

SEQ ID NO: 305293 - DNA, 20 bp, Artificial Sequence
  Description of Artificial Sequence: Synthetic oligonucleotide
  Target: ATXN1; (+) strand; PAM type: YTN; PAM sequence: TTT
aatgtaataatttacaaaat

SEQ ID NO: 305294 - DNA, 20 bp, Artificial Sequence
  Description of Artificial Sequence: Synthetic oligonucleotide
  Target: ATXN1; (+) strand; PAM type: YTN; PAM sequence: TTA
atgtaataatttacaaaatg

SEQ ID NO: 305295 - DNA, 20 bp, Artificial Sequence
  Description of Artificial Sequence: Synthetic oligonucleotide
  Target: ATXN1; (+) strand; PAM type: YTN; PAM sequence: TTT
acaaaatggccatgtcatgg

SEQ ID NO: 305296 - DNA, 20 bp, Artificial Sequence
  Description of Artificial Sequence: Synthetic oligonucleotide
  Target: ATXN1; (+) strand; PAM type: YTN; PAM sequence: TTA
caaaatggccatgtcatggt

SEQ ID NO: 305297 - DNA, 20 bp, Artificial Sequence
  Description of Artificial Sequence: Synthetic oligonucleotide
  Target: ATXN1; (+) strand; PAM type: YTN; PAM sequence: TTA
tttttaattgaataaaatag

SEQ ID NO: 305298 - DNA, 20 bp, Artificial Sequence
  Description of Artificial Sequence: Synthetic oligonucleotide
  Target: ATXN1; (+) strand; PAM type: YTN; PAM sequence: TTT
ttaattgaataaaataggta

SEQ ID NO: 305299 - DNA, 20 bp, Artificial Sequence
  Description of Artificial Sequence: Synthetic oligonucleotide
  Target: ATXN1; (+) strand; PAM type: YTN; PAM sequence: TTT
taattgaataaaataggtag

SEQ ID NO: 305300 - DNA, 20 bp, Artificial Sequence
  Description of Artificial Sequence: Synthetic oligonucleotide
  Target: ATXN1; (+) strand; PAM type: YTN; PAM sequence: TTT
aattgaataaaataggtagc

SEQ ID NO: 305301 - DNA, 20 bp, Artificial Sequence
  Description of Artificial Sequence: Synthetic oligonucleotide
  Target: ATXN1; (+) strand; PAM type: YTN; PAM sequence: TTA
attgaataaaataggtagct

SEQ ID NO: 305302 - DNA, 20 bp, Artificial Sequence
  Description of Artificial Sequence: Synthetic oligonucleotide
  Target: ATXN1; (+) strand; PAM type: YTN; PAM sequence: TTG
aataaaataggtagcttatg

SEQ ID NO: 305303 - DNA, 20 bp, Artificial Sequence
  Description of Artificial Sequence: Synthetic oligonucleotide
  Target: ATXN1; (+) strand; PAM type: YTN; PAM sequence: CTT
atggcttgttttctgtaact

SEQ ID NO: 305304 - DNA, 20 bp, Artificial Sequence
  Description of Artificial Sequence: Synthetic oligonucleotide
  Target: ATXN1; (+) strand; PAM type: YTN; PAM sequence: TTA
tggcttgttttctgtaactc

SEQ ID NO: 305305 - DNA, 20 bp, Artificial Sequence
  Description of Artificial Sequence: Synthetic oligonucleotide
  Target: ATXN1; (+) strand; PAM type: YTN; PAM sequence: CTT
gttttctgtaactcagcctt

SEQ ID NO: 305306 - DNA, 20 bp, Artificial Sequence
  Description of Artificial Sequence: Synthetic oligonucleotide
  Target: ATXN1; (+) strand; PAM type: YTN; PAM sequence: TTG
ttttctgtaactcagcctta

SEQ ID NO: 305307 - DNA, 20 bp, Artificial Sequence
  Description of Artificial Sequence: Synthetic oligonucleotide
  Target: ATXN1; (+) strand; PAM type: YTN; PAM sequence: TTT
tctgtaactcagccttaaca

SEQ ID NO: 305308 - DNA, 20 bp, Artificial Sequence
  Description of Artificial Sequence: Synthetic oligonucleotide
  Target: ATXN1; (+) strand; PAM type: YTN; PAM sequence: TTT
ctgtaactcagccttaacat

SEQ ID NO: 305309 - DNA, 20 bp, Artificial Sequence
  Description of Artificial Sequence: Synthetic oligonucleotide
  Target: ATXN1; (+) strand; PAM type: YTN; PAM sequence: TTC
tgtaactcagccttaacatt

SEQ ID NO: 305310 - DNA, 20 bp, Artificial Sequence
  Description of Artificial Sequence: Synthetic oligonucleotide
  Target: ATXN1; (+) strand; PAM type: YTN; PAM sequence: CTG
taactcagccttaacatttt

SEQ ID NO: 305311 - DNA, 20 bp, Artificial Sequence
  Description of Artificial Sequence: Synthetic oligonucleotide
  Target: ATXN1; (+) strand; PAM type: YTN; PAM sequence: CTC
agccttaacattttgttaag

SEQ ID NO: 305312 - DNA, 20 bp, Artificial Sequence
  Description of Artificial Sequence: Synthetic oligonucleotide
  Target: ATXN1; (+) strand; PAM type: YTN; PAM sequence: CTT
aacattttgttaagcctttc

SEQ ID NO: 305313 - DNA, 20 bp, Artificial Sequence
  Description of Artificial Sequence: Synthetic oligonucleotide
  Target: ATXN1; (+) strand; PAM type: YTN; PAM sequence: TTA
acattttgttaagcctttca

SEQ ID NO: 305314 - DNA, 20 bp, Artificial Sequence
  Description of Artificial Sequence: Synthetic oligonucleotide
  Target: ATXN1; (+) strand; PAM type: YTN; PAM sequence: TTT
tgttaagcctttcatttgtt

SEQ ID NO: 305315 - DNA, 20 bp, Artificial Sequence
  Description of Artificial Sequence: Synthetic oligonucleotide
  Target: ATXN1; (+) strand; PAM type: YTN; PAM sequence: TTT
gttaagcctttcatttgttt

SEQ ID NO: 305316 - DNA, 20 bp, Artificial Sequence
  Description of Artificial Sequence: Synthetic oligonucleotide
  Target: ATXN1; (+) strand; PAM type: YTN; PAM sequence: TTG
ttaagcctttcatttgtttt

SEQ ID NO: 305317 - DNA, 20 bp, Artificial Sequence
  Description of Artificial Sequence: Synthetic oligonucleotide
  Target: ATXN1; (+) strand; PAM type: YTN; PAM sequence: TTA
agcctttcatttgttttcct

SEQ ID NO: 305318 - DNA, 20 bp, Artificial Sequence
  Description of Artificial Sequence: Synthetic oligonucleotide
  Target: ATXN1; (+) strand; PAM type: YTN; PAM sequence: CTT
tcatttgttttcctcagaag

SEQ ID NO: 305319 - DNA, 20 bp, Artificial Sequence
  Description of Artificial Sequence: Synthetic oligonucleotide
  Target: ATXN1; (+) strand; PAM type: YTN; PAM sequence: TTT
catttgttttcctcagaaga

SEQ ID NO: 305320 - DNA, 20 bp, Artificial Sequence
  Description of Artificial Sequence: Synthetic oligonucleotide
  Target: ATXN1; (+) strand; PAM type: YTN; PAM sequence: TTC
atttgttttcctcagaagat

SEQ ID NO: 305321 - DNA, 20 bp, Artificial Sequence
  Description of Artificial Sequence: Synthetic oligonucleotide
  Target: ATXN1; (+) strand; PAM type: YTN; PAM sequence: TTT
gttttcctcagaagatgtgc

SEQ ID NO: 305322 - DNA, 20 bp, Artificial Sequence
  Description of Artificial Sequence: Synthetic oligonucleotide
  Target: ATXN1; (+) strand; PAM type: YTN; PAM sequence: TTG
ttttcctcagaagatgtgcc

SEQ ID NO: 305323 - DNA, 20 bp, Artificial Sequence
  Description of Artificial Sequence: Synthetic oligonucleotide
  Target: ATXN1; (+) strand; PAM type: YTN; PAM sequence: TTT
tcctcagaagatgtgcctat

SEQ ID NO: 305324 - DNA, 20 bp, Artificial Sequence
  Description of Artificial Sequence: Synthetic oligonucleotide
  Target: ATXN1; (+) strand; PAM type: YTN; PAM sequence: TTT
cctcagaagatgtgcctatc

SEQ ID NO: 305325 - DNA, 20 bp, Artificial Sequence
  Description of Artificial Sequence: Synthetic oligonucleotide
  Target: ATXN1; (+) strand; PAM type: YTN; PAM sequence: TTC
ctcagaagatgtgcctatct

SEQ ID NO: 305326 - DNA, 20 bp, Artificial Sequence
  Description of Artificial Sequence: Synthetic oligonucleotide
  Target: ATXN1; (+) strand; PAM type: YTN; PAM sequence: CTC
agaagatgtgcctatctttc

SEQ ID NO: 305327 - DNA, 20 bp, Artificial Sequence
  Description of Artificial Sequence: Synthetic oligonucleotide
  Target: ATXN1; (+) strand; PAM type: YTN; PAM sequence: CTA
tctttcaattctaaataaat

SEQ ID NO: 305328 - DNA, 20 bp, Artificial Sequence
  Description of Artificial Sequence: Synthetic oligonucleotide
  Target: ATXN1; (+) strand; PAM type: YTN; PAM sequence: CTT
tcaattctaaataaatggtt

SEQ ID NO: 305329 - DNA, 20 bp, Artificial Sequence
  Description of Artificial Sequence: Synthetic oligonucleotide
  Target: ATXN1; (+) strand; PAM type: YTN; PAM sequence: TTT
caattctaaataaatggttc

SEQ ID NO: 305330 - DNA, 20 bp, Artificial Sequence
  Description of Artificial Sequence: Synthetic oligonucleotide
  Target: ATXN1; (+) strand; PAM type: YTN; PAM sequence: TTC
aattctaaataaatggttcc

SEQ ID NO: 305331 - DNA, 20 bp, Artificial Sequence
  Description of Artificial Sequence: Synthetic oligonucleotide
  Target: ATXN1; (+) strand; PAM type: YTN; PAM sequence: TTC
taaataaatggttcctatga

SEQ ID NO: 305332 - DNA, 20 bp, Artificial Sequence
  Description of Artificial Sequence: Synthetic oligonucleotide
  Target: ATXN1; (+) strand; PAM type: YTN; PAM sequence: CTA
aataaatggttcctatgaac

SEQ ID NO: 305333 - DNA, 20 bp, Artificial Sequence
  Description of Artificial Sequence: Synthetic oligonucleotide
  Target: ATXN1; (+) strand; PAM type: YTN; PAM sequence: TTC
ctatgaaccttttgagaaac

SEQ ID NO: 305334 - DNA, 20 bp, Artificial Sequence
  Description of Artificial Sequence: Synthetic oligonucleotide
  Target: ATXN1; (+) strand; PAM type: YTN; PAM sequence: CTA
tgaaccttttgagaaacaga

SEQ ID NO: 305335 - DNA, 20 bp, Artificial Sequence
  Description of Artificial Sequence: Synthetic oligonucleotide
  Target: ATXN1; (+) strand; PAM type: YTN; PAM sequence: CTT
ttgagaaacagaattcttgg

SEQ ID NO: 305336 - DNA, 20 bp, Artificial Sequence
  Description of Artificial Sequence: Synthetic oligonucleotide
  Target: ATXN1; (+) strand; PAM type: YTN; PAM sequence: TTT
tgagaaacagaattcttgga

SEQ ID NO: 305337 - DNA, 20 bp, Artificial Sequence
  Description of Artificial Sequence: Synthetic oligonucleotide
  Target: ATXN1; (+) strand; PAM type: YTN; PAM sequence: TTT
gagaaacagaattcttggag

SEQ ID NO: 305338 - DNA, 20 bp, Artificial Sequence
  Description of Artificial Sequence: Synthetic oligonucleotide
  Target: ATXN1; (+) strand; PAM type: YTN; PAM sequence: TTG
agaaacagaattcttggagg

SEQ ID NO: 305339 - DNA, 20 bp, Artificial Sequence
  Description of Artificial Sequence: Synthetic oligonucleotide
  Target: ATXN1; (+) strand; PAM type: YTN; PAM sequence: TTC
ttggaggatctgattgaaag

SEQ ID NO: 305340 - DNA, 20 bp, Artificial Sequence
  Description of Artificial Sequence: Synthetic oligonucleotide
  Target: ATXN1; (+) strand; PAM type: YTN; PAM sequence: CTT
ggaggatctgattgaaagct

SEQ ID NO: 305341 - DNA, 20 bp, Artificial Sequence
  Description of Artificial Sequence: Synthetic oligonucleotide
  Target: ATXN1; (+) strand; PAM type: YTN; PAM sequence: TTG
gaggatctgattgaaagcta

SEQ ID NO: 305342 - DNA, 20 bp, Artificial Sequence
  Description of Artificial Sequence: Synthetic oligonucleotide
  Target: ATXN1; (+) strand; PAM type: YTN; PAM sequence: CTG
attgaaagctacaatcctct

SEQ ID NO: 305343 - DNA, 20 bp, Artificial Sequence
  Description of Artificial Sequence: Synthetic oligonucleotide
  Target: ATXN1; (+) strand; PAM type: YTN; PAM sequence: TTG
aaagctacaatcctctccca

SEQ ID NO: 305344 - DNA, 20 bp, Artificial Sequence
  Description of Artificial Sequence: Synthetic oligonucleotide
  Target: ATXN1; (+) strand; PAM type: YTN; PAM sequence: CTA
caatcctctcccagaaaaac

SEQ ID NO: 305345 - DNA, 20 bp, Artificial Sequence
  Description of Artificial Sequence: Synthetic oligonucleotide
  Target: ATXN1; (+) strand; PAM type: YTN; PAM sequence: CTC
tcccagaaaaacccacatac

SEQ ID NO: 305346 - DNA, 20 bp, Artificial Sequence
  Description of Artificial Sequence: Synthetic oligonucleotide
  Target: ATXN1; (+) strand; PAM type: YTN; PAM sequence: CTC
ccagaaaaacccacatacac

SEQ ID NO: 305347 - DNA, 20 bp, Artificial Sequence
  Description of Artificial Sequence: Synthetic oligonucleotide
  Target: ATXN1; (+) strand; PAM type: YTN; PAM sequence: CTG
taatacagttcctgggggag

SEQ ID NO: 305348 - DNA, 20 bp, Artificial Sequence
  Description of Artificial Sequence: Synthetic oligonucleotide
  Target: ATXN1; (+) strand; PAM type: YTN; PAM sequence: TTC
ctgggggagccttgggacgt

SEQ ID NO: 305349 - DNA, 20 bp, Artificial Sequence
  Description of Artificial Sequence: Synthetic oligonucleotide
  Target: ATXN1; (+) strand; PAM type: YTN; PAM sequence: CTG
ggggagccttgggacgttct

SEQ ID NO: 305350 - DNA, 20 bp, Artificial Sequence
  Description of Artificial Sequence: Synthetic oligonucleotide
  Target: ATXN1; (+) strand; PAM type: YTN; PAM sequence: CTT
gggacgttctggaaaagttc

SEQ ID NO: 305351 - DNA, 20 bp, Artificial Sequence
  Description of Artificial Sequence: Synthetic oligonucleotide
  Target: ATXN1; (+) strand; PAM type: YTN; PAM sequence: TTG
ggacgttctggaaaagttca

SEQ ID NO: 305352 - DNA, 20 bp, Artificial Sequence
  Description of Artificial Sequence: Synthetic oligonucleotide
  Target: ATXN1; (+) strand; PAM type: YTN; PAM sequence: TTC
tggaaaagttcagtgatcag

SEQ ID NO: 305353 - DNA, 20 bp, Artificial Sequence
  Description of Artificial Sequence: Synthetic oligonucleotide
  Target: ATXN1; (+) strand; PAM type: YTN; PAM sequence: CTG
gaaaagttcagtgatcagaa

SEQ ID NO: 305354 - DNA, 20 bp, Artificial Sequence
  Description of Artificial Sequence: Synthetic oligonucleotide
  Target: ATXN1; (+) strand; PAM type: YTN; PAM sequence: TTC
agtgatcagaaatgaagaat

SEQ ID NO: 305355 - DNA, 20 bp, Artificial Sequence
  Description of Artificial Sequence: Synthetic oligonucleotide
  Target: ATXN1; (+) strand; PAM type: YTN; PAM sequence: TTC
ccaaccaccttattgcagtg

SEQ ID NO: 305356 - DNA, 20 bp, Artificial Sequence
  Description of Artificial Sequence: Synthetic oligonucleotide
  Target: ATXN1; (+) strand; PAM type: YTN; PAM sequence: CTT
attgcagtggccgcaaaggg

SEQ ID NO: 305357 - DNA, 20 bp, Artificial Sequence
  Description of Artificial Sequence: Synthetic oligonucleotide
  Target: ATXN1; (+) strand; PAM type: YTN; PAM sequence: TTA
ttgcagtggccgcaaagggg

SEQ ID NO: 305358 - DNA, 20 bp, Artificial Sequence
  Description of Artificial Sequence: Synthetic oligonucleotide
  Target: ATXN1; (+) strand; PAM type: YTN; PAM sequence: TTG
cagtggccgcaaaggggcac

SEQ ID NO: 305359 - DNA, 20 bp, Artificial Sequence
  Description of Artificial Sequence: Synthetic oligonucleotide
  Target: ATXN1; (+) strand; PAM type: YTN; PAM sequence: CTC
agtggcctcacctgaccact

SEQ ID NO: 305360 - DNA, 20 bp, Artificial Sequence
  Description of Artificial Sequence: Synthetic oligonucleotide
  Target: ATXN1; (+) strand; PAM type: YTN; PAM sequence: CTC
acctgaccactgcaaagatt

SEQ ID NO: 305361 - DNA, 20 bp, Artificial Sequence
  Description of Artificial Sequence: Synthetic oligonucleotide
  Target: ATXN1; (+) strand; PAM type: YTN; PAM sequence: CTG
accactgcaaagattcgttc

SEQ ID NO: 305362 - DNA, 20 bp, Artificial Sequence
  Description of Artificial Sequence: Synthetic oligonucleotide
  Target: ATXN1; (+) strand; PAM type: YTN; PAM sequence: CTG
caaagattcgttcttctagc

SEQ ID NO: 305363 - DNA, 20 bp, Artificial Sequence
  Description of Artificial Sequence: Synthetic oligonucleotide
  Target: ATXN1; (+) strand; PAM type: YTN; PAM sequence: TTC
gttcttctagccagcctaca

SEQ ID NO: 305364 - DNA, 20 bp, Artificial Sequence
  Description of Artificial Sequence: Synthetic oligonucleotide
  Target: ATXN1; (+) strand; PAM type: YTN; PAM sequence: TTC
ttctagccagcctacacaat

SEQ ID NO: 305365 - DNA, 20 bp, Artificial Sequence
  Description of Artificial Sequence: Synthetic oligonucleotide
  Target: ATXN1; (+) strand; PAM type: YTN; PAM sequence: CTT
ctagccagcctacacaatta

SEQ ID NO: 305366 - DNA, 20 bp, Artificial Sequence
  Description of Artificial Sequence: Synthetic oligonucleotide
  Target: ATXN1; (+) strand; PAM type: YTN; PAM sequence: TTC
tagccagcctacacaattag

SEQ ID NO: 305367 - DNA, 20 bp, Artificial Sequence
  Description of Artificial Sequence: Synthetic oligonucleotide
  Target: ATXN1; (+) strand; PAM type: YTN; PAM sequence: CTA
gccagcctacacaattaggc

SEQ ID NO: 305368 - DNA, 20 bp, Artificial Sequence
  Description of Artificial Sequence: Synthetic oligonucleotide
  Target: ATXN1; (+) strand; PAM type: YTN; PAM sequence: CTA
cacaattaggcaccaactca

SEQ ID NO: 305369 - DNA, 20 bp, Artificial Sequence
  Description of Artificial Sequence: Synthetic oligonucleotide
  Target: ATXN1; (+) strand; PAM type: YTN; PAM sequence: TTA
ggcaccaactcaaagcaata

SEQ ID NO: 305370 - DNA, 20 bp, Artificial Sequence
  Description of Artificial Sequence: Synthetic oligonucleotide
  Target: ATXN1; (+) strand; PAM type: YTN; PAM sequence: CTC
aaagcaatatcatgttgcaa

SEQ ID NO: 305371 - DNA, 20 bp, Artificial Sequence
  Description of Artificial Sequence: Synthetic oligonucleotide
  Target: ATXN1; (+) strand; PAM type: YTN; PAM sequence: TTG
caaactatgcagcattaact

SEQ ID NO: 305372 - DNA, 20 bp, Artificial Sequence
  Description of Artificial Sequence: Synthetic oligonucleotide
  Target: ATXN1; (+) strand; PAM type: YTN; PAM sequence: CTA
tgcagcattaactgatgttg

SEQ ID NO: 305373 - DNA, 20 bp, Artificial Sequence
  Description of Artificial Sequence: Synthetic oligonucleotide
  Target: ATXN1; (+) strand; PAM type: YTN; PAM sequence: TTA
actgatgttgaggaaatgaa

SEQ ID NO: 305374 - DNA, 20 bp, Artificial Sequence
  Description of Artificial Sequence: Synthetic oligonucleotide
  Target: ATXN1; (+) strand; PAM type: YTN; PAM sequence: CTG
atgttgaggaaatgaaagga

SEQ ID NO: 305375 - DNA, 20 bp, Artificial Sequence
  Description of Artificial Sequence: Synthetic oligonucleotide
  Target: ATXN1; (+) strand; PAM type: YTN; PAM sequence: TTG
aggaaatgaaaggagataac

SEQ ID NO: 305376 - DNA, 20 bp, Artificial Sequence
  Description of Artificial Sequence: Synthetic oligonucleotide
  Target: ATXN1; (+) strand; PAM type: YTN; PAM sequence: TTA
cacacttctcccaaatggca

SEQ ID NO: 305377 - DNA, 20 bp, Artificial Sequence
  Description of Artificial Sequence: Synthetic oligonucleotide
  Target: ATXN1; (+) strand; PAM type: YTN; PAM sequence: CTT
ctcccaaatggcactgcagc

SEQ ID NO: 305378 - DNA, 20 bp, Artificial Sequence
  Description of Artificial Sequence: Synthetic oligonucleotide
  Target: ATXN1; (+) strand; PAM type: YTN; PAM sequence: TTC
tcccaaatggcactgcagca

SEQ ID NO: 305379 - DNA, 20 bp, Artificial Sequence
  Description of Artificial Sequence: Synthetic oligonucleotide
  Target: ATXN1; (+) strand; PAM type: YTN; PAM sequence: CTC
ccaaatggcactgcagcagg

SEQ ID NO: 305380 - DNA, 20 bp, Artificial Sequence
  Description of Artificial Sequence: Synthetic oligonucleotide
  Target: ATXN1; (+) strand; PAM type: YTN; PAM sequence: CTG
cagcagggggcggctgtaag

SEQ ID NO: 305381 - DNA, 20 bp, Artificial Sequence
  Description of Artificial Sequence: Synthetic oligonucleotide
  Target: ATXN1; (+) strand; PAM type: YTN; PAM sequence: CTG
taagccaggcaacaggagat

SEQ ID NO: 305382 - DNA, 20 bp, Artificial Sequence
  Description of Artificial Sequence: Synthetic oligonucleotide
  Target: ATXN1; (+) strand; PAM type: YTN; PAM sequence: TTC
attagccatgacctcccaat

SEQ ID NO: 305383 - DNA, 20 bp, Artificial Sequence
  Description of Artificial Sequence: Synthetic oligonucleotide
  Target: ATXN1; (+) strand; PAM type: YTN; PAM sequence: TTA
gccatgacctcccaatgcca

SEQ ID NO: 305384 - DNA, 20 bp, Artificial Sequence
  Description of Artificial Sequence: Synthetic oligonucleotide
  Target: ATXN1; (+) strand; PAM type: YTN; PAM sequence: CTC
ccaatgccaagaaagggccc

SEQ ID NO: 305385 - DNA, 20 bp, Artificial Sequence
  Description of Artificial Sequence: Synthetic oligonucleotide
  Target: ATXN1; (+) strand; PAM type: YTN; PAM sequence: TTC
agcaaatggggatgattaga

SEQ ID NO: 305386 - DNA, 20 bp, Artificial Sequence
  Description of Artificial Sequence: Synthetic oligonucleotide
  Target: ATXN1; (+) strand; PAM type: YTN; PAM sequence: TTA
gaaattttacaagaaaatga

SEQ ID NO: 305387 - DNA, 20 bp, Artificial Sequence
  Description of Artificial Sequence: Synthetic oligonucleotide
  Target: ATXN1; (+) strand; PAM type: YTN; PAM sequence: TTT
tacaagaaaatgaaatcttg

SEQ ID NO: 305388 - DNA, 20 bp, Artificial Sequence
  Description of Artificial Sequence: Synthetic oligonucleotide
  Target: ATXN1; (+) strand; PAM type: YTN; PAM sequence: TTT
acaagaaaatgaaatcttga

SEQ ID NO: 305389 - DNA, 20 bp, Artificial Sequence
  Description of Artificial Sequence: Synthetic oligonucleotide
  Target: ATXN1; (+) strand; PAM type: YTN; PAM sequence: TTA
caagaaaatgaaatcttgag

SEQ ID NO: 305390 - DNA, 20 bp, Artificial Sequence
  Description of Artificial Sequence: Synthetic oligonucleotide
  Target: ATXN1; (+) strand; PAM type: YTN; PAM sequence: CTT
gagcttttaattttactgaa

SEQ ID NO: 305391 - DNA, 20 bp, Artificial Sequence
  Description of Artificial Sequence: Synthetic oligonucleotide
  Target: ATXN1; (+) strand; PAM type: YTN; PAM sequence: TTG
agcttttaattttactgaaa

SEQ ID NO: 305392 - DNA, 20 bp, Artificial Sequence
  Description of Artificial Sequence: Synthetic oligonucleotide
  Target: ATXN1; (+) strand; PAM type: YTN; PAM sequence: CTT
ttaattttactgaaatgtga

SEQ ID NO: 305393 - DNA, 20 bp, Artificial Sequence
  Description of Artificial Sequence: Synthetic oligonucleotide
  Target: ATXN1; (+) strand; PAM type: YTN; PAM sequence: TTT
taattttactgaaatgtgat

SEQ ID NO: 305394 - DNA, 20 bp, Artificial Sequence
  Description of Artificial Sequence: Synthetic oligonucleotide
  Target: ATXN1; (+) strand; PAM type: YTN; PAM sequence: TTT
aattttactgaaatgtgatt

SEQ ID NO: 305395 - DNA, 20 bp, Artificial Sequence
  Description of Artificial Sequence: Synthetic oligonucleotide
  Target: ATXN1; (+) strand; PAM type: YTN; PAM sequence: TTA
attttactgaaatgtgattt

SEQ ID NO: 305396 - DNA, 20 bp, Artificial Sequence
  Description of Artificial Sequence: Synthetic oligonucleotide
  Target: ATXN1; (+) strand; PAM type: YTN; PAM sequence: TTT
tactgaaatgtgattttctg

SEQ ID NO: 305397 - DNA, 20 bp, Artificial Sequence
  Description of Artificial Sequence: Synthetic oligonucleotide
  Target: ATXN1; (+) strand; PAM type: YTN; PAM sequence: TTT
actgaaatgtgattttctgc

SEQ ID NO: 305398 - DNA, 20 bp, Artificial Sequence
  Description of Artificial Sequence: Synthetic oligonucleotide
  Target: ATXN1; (+) strand; PAM type: YTN; PAM sequence: TTA
ctgaaatgtgattttctgct

SEQ ID NO: 305399 - DNA, 20 bp, Artificial Sequence
  Description of Artificial Sequence: Synthetic oligonucleotide
  Target: ATXN1; (+) strand; PAM type: YTN; PAM sequence: CTG
aaatgtgattttctgctttc

SEQ ID NO: 305400 - DNA, 20 bp, Artificial Sequence
  Description of Artificial Sequence: Synthetic oligonucleotide
  Target: ATXN1; (+) strand; PAM type: YTN; PAM sequence: TTT
tctgctttcaactcaaaatg

SEQ ID NO: 305401 - DNA, 20 bp, Artificial Sequence
  Description of Artificial Sequence: Synthetic oligonucleotide
  Target: ATXN1; (+) strand; PAM type: YTN; PAM sequence: TTT
ctgctttcaactcaaaatgc

SEQ ID NO: 305402 - DNA, 20 bp, Artificial Sequence
  Description of Artificial Sequence: Synthetic oligonucleotide
  Target: ATXN1; (+) strand; PAM type: YTN; PAM sequence: TTC
tgctttcaactcaaaatgca

SEQ ID NO: 305403 - DNA, 20 bp, Artificial Sequence
  Description of Artificial Sequence: Synthetic oligonucleotide
  Target: ATXN1; (+) strand; PAM type: YTN; PAM sequence: CTG
ctttcaactcaaaatgcatt

SEQ ID NO: 305404 - DNA, 20 bp, Artificial Sequence
  Description of Artificial Sequence: Synthetic oligonucleotide
  Target: ATXN1; (+) strand; PAM type: YTN; PAM sequence: CTT
tcaactcaaaatgcatttac

SEQ ID NO: 305405 - DNA, 20 bp, Artificial Sequence
  Description of Artificial Sequence: Synthetic oligonucleotide
  Target: ATXN1; (+) strand; PAM type: YTN; PAM sequence: TTT
caactcaaaatgcatttaca

SEQ ID NO: 305406 - DNA, 20 bp, Artificial Sequence
  Description of Artificial Sequence: Synthetic oligonucleotide
  Target: ATXN1; (+) strand; PAM type: YTN; PAM sequence: TTC
aactcaaaatgcatttacat

SEQ ID NO: 305407 - DNA, 20 bp, Artificial Sequence
  Description of Artificial Sequence: Synthetic oligonucleotide
  Target: ATXN1; (+) strand; PAM type: YTN; PAM sequence: CTC
aaaatgcatttacatgttcc

SEQ ID NO: 305408 - DNA, 20 bp, Artificial Sequence
  Description of Artificial Sequence: Synthetic oligonucleotide
  Target: ATXN1; (+) strand; PAM type: YTN; PAM sequence: TTT
acatgttccacgtcctgtga

SEQ ID NO: 305409 - DNA, 20 bp, Artificial Sequence
  Description of Artificial Sequence: Synthetic oligonucleotide
  Target: ATXN1; (+) strand; PAM type: YTN; PAM sequence: TTA
catgttccacgtcctgtgaa

SEQ ID NO: 305410 - DNA, 20 bp, Artificial Sequence
  Description of Artificial Sequence: Synthetic oligonucleotide
  Target: ATXN1; (+) strand; PAM type: YTN; PAM sequence: TTC
cacgtcctgtgaagttataa

SEQ ID NO: 305411 - DNA, 20 bp, Artificial Sequence
  Description of Artificial Sequence: Synthetic oligonucleotide
  Target: ATXN1; (+) strand; PAM type: YTN; PAM sequence: CTG
tgaagttataaagaaaagat

SEQ ID NO: 305412 - DNA, 20 bp, Artificial Sequence
  Description of Artificial Sequence: Synthetic oligonucleotide
  Target: ATXN1; (+) strand; PAM type: YTN; PAM sequence: TTA
taaagaaaagatacatttaa

SEQ ID NO: 305413 - DNA, 20 bp, Artificial Sequence
  Description of Artificial Sequence: Synthetic oligonucleotide
  Target: ATXN1; (+) strand; PAM type: YTN; PAM sequence: TTT
aaatgaacaaaagccaaagg

SEQ ID NO: 305414 - DNA, 20 bp, Artificial Sequence
  Description of Artificial Sequence: Synthetic oligonucleotide
  Target: ATXN1; (+) strand; PAM type: YTN; PAM sequence: TTA
aatgaacaaaagccaaagga

SEQ ID NO: 305415 - DNA, 20 bp, Artificial Sequence
  Description of Artificial Sequence: Synthetic oligonucleotide
  Target: ATXN1; (+) strand; PAM type: YTN; PAM sequence: CTC
actaataatagtctaattac

SEQ ID NO: 305416 - DNA, 20 bp, Artificial Sequence
  Description of Artificial Sequence: Synthetic oligonucleotide
  Target: ATXN1; (+) strand; PAM type: YTN; PAM sequence: CTA
ataatagtctaattacaaaa

SEQ ID NO: 305417 - DNA, 20 bp, Artificial Sequence
  Description of Artificial Sequence: Synthetic oligonucleotide
  Target: ATXN1; (+) strand; PAM type: YTN; PAM sequence: CTA
attacaaaaaagtatctccc

SEQ ID NO: 305418 - DNA, 20 bp, Artificial Sequence
  Description of Artificial Sequence: Synthetic oligonucleotide
  Target: ATXN1; (+) strand; PAM type: YTN; PAM sequence: TTA
caaaaaagtatctcccccca

SEQ ID NO: 305419 - DNA, 20 bp, Artificial Sequence
  Description of Artificial Sequence: Synthetic oligonucleotide
  Target: ATXN1; (+) strand; PAM type: YTN; PAM sequence: CTC
cccccacctgccccactgtt

SEQ ID NO: 305420 - DNA, 20 bp, Artificial Sequence
  Description of Artificial Sequence: Synthetic oligonucleotide
  Target: ATXN1; (+) strand; PAM type: YTN; PAM sequence: CTG
ccccactgtttgttcaataa

SEQ ID NO: 305421 - DNA, 20 bp, Artificial Sequence
  Description of Artificial Sequence: Synthetic oligonucleotide
  Target: ATXN1; (+) strand; PAM type: YTN; PAM sequence: CTG
tttgttcaataaaactgatt

SEQ ID NO: 305422 - DNA, 20 bp, Artificial Sequence
  Description of Artificial Sequence: Synthetic oligonucleotide
  Target: ATXN1; (+) strand; PAM type: YTN; PAM sequence: TTT
gttcaataaaactgattcca

SEQ ID NO: 305423 - DNA, 20 bp, Artificial Sequence
  Description of Artificial Sequence: Synthetic oligonucleotide
  Target: ATXN1; (+) strand; PAM type: YTN; PAM sequence: TTG
ttcaataaaactgattccat

SEQ ID NO: 305424 - DNA, 20 bp, Artificial Sequence
  Description of Artificial Sequence: Synthetic oligonucleotide
  Target: ATXN1; (+) strand; PAM type: YTN; PAM sequence: TTC
aataaaactgattccataca

SEQ ID NO: 305425 - DNA, 20 bp, Artificial Sequence
  Description of Artificial Sequence: Synthetic oligonucleotide
  Target: ATXN1; (+) strand; PAM type: YTN; PAM sequence: CTG
attccatacactgaaccatc

SEQ ID NO: 305426 - DNA, 20 bp, Artificial Sequence
  Description of Artificial Sequence: Synthetic oligonucleotide
  Target: ATXN1; (+) strand; PAM type: YTN; PAM sequence: TTC
catacactgaaccatctcac

SEQ ID NO: 305427 - DNA, 20 bp, Artificial Sequence
  Description of Artificial Sequence: Synthetic oligonucleotide
  Target: ATXN1; (+) strand; PAM type: YTN; PAM sequence: CTG
aaccatctcactatcgcttt

SEQ ID NO: 305428 - DNA, 20 bp, Artificial Sequence
  Description of Artificial Sequence: Synthetic oligonucleotide
  Target: ATXN1; (+) strand; PAM type: YTN; PAM sequence: CTC
actatcgcttttctgggcta

SEQ ID NO: 305429 - DNA, 20 bp, Artificial Sequence
  Description of Artificial Sequence: Synthetic oligonucleotide
  Target: ATXN1; (+) strand; PAM type: YTN; PAM sequence: CTA
tcgcttttctgggctacatg

SEQ ID NO: 305430 - DNA, 20 bp, Artificial Sequence
  Description of Artificial Sequence: Synthetic oligonucleotide
  Target: ATXN1; (+) strand; PAM type: YTN; PAM sequence: CTT
ttctgggctacatgtatatg

SEQ ID NO: 305431 - DNA, 20 bp, Artificial Sequence
  Description of Artificial Sequence: Synthetic oligonucleotide
  Target: ATXN1; (+) strand; PAM type: YTN; PAM sequence: TTT
tctgggctacatgtatatga

SEQ ID NO: 305432 - DNA, 20 bp, Artificial Sequence
  Description of Artificial Sequence: Synthetic oligonucleotide
  Target: ATXN1; (+) strand; PAM type: YTN; PAM sequence: TTT
ctgggctacatgtatatgag

SEQ ID NO: 305433 - DNA, 20 bp, Artificial Sequence
  Description of Artificial Sequence: Synthetic oligonucleotide
  Target: ATXN1; (+) strand; PAM type: YTN; PAM sequence: TTC
tgggctacatgtatatgagc

SEQ ID NO: 305434 - DNA, 20 bp, Artificial Sequence
  Description of Artificial Sequence: Synthetic oligonucleotide
  Target: ATXN1; (+) strand; PAM type: YTN; PAM sequence: CTG
ggctacatgtatatgagcgc

SEQ ID NO: 305435 - DNA, 20 bp, Artificial Sequence
  Description of Artificial Sequence: Synthetic oligonucleotide
  Target: ATXN1; (+) strand; PAM type: YTN; PAM sequence: CTA
catgtatatgagcgcaaaac

SEQ ID NO: 305436 - DNA, 20 bp, Artificial Sequence
  Description of Artificial Sequence: Synthetic oligonucleotide
  Target: ATXN1; (+) strand; PAM type: YTN; PAM sequence: CTC
acagtaaataacgataataa

SEQ ID NO: 305437 - DNA, 20 bp, Artificial Sequence
  Description of Artificial Sequence: Synthetic oligonucleotide
  Target: ATXN1; (+) strand; PAM type: YTN; PAM sequence: CTA
caattatccagagaaaatat

SEQ ID NO: 305438 - DNA, 20 bp, Artificial Sequence
  Description of Artificial Sequence: Synthetic oligonucleotide
  Target: ATXN1; (+) strand; PAM type: YTN; PAM sequence: TTA
tccagagaaaatatgtcaaa

SEQ ID NO: 305439 - DNA, 20 bp, Artificial Sequence
  Description of Artificial Sequence: Synthetic oligonucleotide
  Target: ATXN1; (+) strand; PAM type: YTN; PAM sequence: TTA
taaagtctctgagtcatgat

SEQ ID NO: 305440 - DNA, 20 bp, Artificial Sequence
  Description of Artificial Sequence: Synthetic oligonucleotide
  Target: ATXN1; (+) strand; PAM type: YTN; PAM sequence: CTC
tgagtcatgatagtaatcaa

SEQ ID NO: 305441 - DNA, 20 bp, Artificial Sequence
  Description of Artificial Sequence: Synthetic oligonucleotide
  Target: ATXN1; (+) strand; PAM type: YTN; PAM sequence: CTG
agtcatgatagtaatcaaac

SEQ ID NO: 305442 - DNA, 20 bp, Artificial Sequence
  Description of Artificial Sequence: Synthetic oligonucleotide
  Target: ATXN1; (+) strand; PAM type: YTN; PAM sequence: CTG
agtctctattggctttacaa

SEQ ID NO: 305443 - DNA, 20 bp, Artificial Sequence
  Description of Artificial Sequence: Synthetic oligonucleotide
  Target: ATXN1; (+) strand; PAM type: YTN; PAM sequence: CTC
tattggctttacaaaacact

SEQ ID NO: 305444 - DNA, 20 bp, Artificial Sequence
  Description of Artificial Sequence: Synthetic oligonucleotide
  Target: ATXN1; (+) strand; PAM type: YTN; PAM sequence: CTA
ttggctttacaaaacactat

SEQ ID NO: 305445 - DNA, 20 bp, Artificial Sequence
  Description of Artificial Sequence: Synthetic oligonucleotide
  Target: ATXN1; (+) strand; PAM type: YTN; PAM sequence: TTG
gctttacaaaacactattaa

SEQ ID NO: 305446 - DNA, 20 bp, Artificial Sequence
  Description of Artificial Sequence: Synthetic oligonucleotide
  Target: ATXN1; (+) strand; PAM type: YTN; PAM sequence: CTT
tacaaaacactattaatatt

SEQ ID NO: 305447 - DNA, 20 bp, Artificial Sequence
  Description of Artificial Sequence: Synthetic oligonucleotide
  Target: ATXN1; (+) strand; PAM type: YTN; PAM sequence: TTT
acaaaacactattaatattt

SEQ ID NO: 305448 - DNA, 20 bp, Artificial Sequence
  Description of Artificial Sequence: Synthetic oligonucleotide
  Target: ATXN1; (+) strand; PAM type: YTN; PAM sequence: TTA
caaaacactattaatatttc

SEQ ID NO: 305449 - DNA, 20 bp, Artificial Sequence
  Description of Artificial Sequence: Synthetic oligonucleotide
  Target: ATXN1; (+) strand; PAM type: YTN; PAM sequence: CTA
ttaatatttcctgtaataaa

SEQ ID NO: 305450 - DNA, 20 bp, Artificial Sequence
  Description of Artificial Sequence: Synthetic oligonucleotide
  Target: ATXN1; (+) strand; PAM type: YTN; PAM sequence: TTA
atatttcctgtaataaaaac

SEQ ID NO: 305451 - DNA, 20 bp, Artificial Sequence
  Description of Artificial Sequence: Synthetic oligonucleotide
  Target: ATXN1; (+) strand; PAM type: YTN; PAM sequence: TTT
cctgtaataaaaactgaggt

SEQ ID NO: 305452 - DNA, 20 bp, Artificial Sequence
  Description of Artificial Sequence: Synthetic oligonucleotide
  Target: ATXN1; (+) strand; PAM type: YTN; PAM sequence: TTC
ctgtaataaaaactgaggtg

SEQ ID NO: 305453 - DNA, 20 bp, Artificial Sequence
  Description of Artificial Sequence: Synthetic oligonucleotide
  Target: ATXN1; (+) strand; PAM type: YTN; PAM sequence: CTG
taataaaaactgaggtgtag

SEQ ID NO: 305454 - DNA, 20 bp, Artificial Sequence
  Description of Artificial Sequence: Synthetic oligonucleotide
  Target: ATXN1; (+) strand; PAM type: YTN; PAM sequence: CTG
aggtgtagttactcaggttc

SEQ ID NO: 305455 - DNA, 20 bp, Artificial Sequence
  Description of Artificial Sequence: Synthetic oligonucleotide
  Target: ATXN1; (+) strand; PAM type: YTN; PAM sequence: TTA
ctcaggttctttagtgagtc

SEQ ID NO: 305456 - DNA, 20 bp, Artificial Sequence
  Description of Artificial Sequence: Synthetic oligonucleotide
  Target: ATXN1; (+) strand; PAM type: YTN; PAM sequence: CTC
aggttctttagtgagtcaac

SEQ ID NO: 305457 - DNA, 20 bp, Artificial Sequence
  Description of Artificial Sequence: Synthetic oligonucleotide
  Target: ATXN1; (+) strand; PAM type: YTN; PAM sequence: TTC
tttagtgagtcaacacatgt

SEQ ID NO: 305458 - DNA, 20 bp, Artificial Sequence
  Description of Artificial Sequence: Synthetic oligonucleotide
  Target: ATXN1; (+) strand; PAM type: YTN; PAM sequence: CTT
tagtgagtcaacacatgtaa

SEQ ID NO: 305459 - DNA, 20 bp, Artificial Sequence
  Description of Artificial Sequence: Synthetic oligonucleotide
  Target: ATXN1; (+) strand; PAM type: YTN; PAM sequence: TTT
agtgagtcaacacatgtaat

SEQ ID NO: 305460 - DNA, 20 bp, Artificial Sequence
  Description of Artificial Sequence: Synthetic oligonucleotide
  Target: ATXN1; (+) strand; PAM type: YTN; PAM sequence: TTA
gtgagtcaacacatgtaatt

SEQ ID NO: 305461 - DNA, 20 bp, Artificial Sequence
  Description of Artificial Sequence: Synthetic oligonucleotide
  Target: ATXN1; (+) strand; PAM type: YTN; PAM sequence: TTT
gctaaagctgaaacacactg

SEQ ID NO: 305462 - DNA, 20 bp, Artificial Sequence
  Description of Artificial Sequence: Synthetic oligonucleotide
  Target: ATXN1; (+) strand; PAM type: YTN; PAM sequence: TTG
ctaaagctgaaacacactgt

SEQ ID NO: 305463 - DNA, 20 bp, Artificial Sequence
  Description of Artificial Sequence: Synthetic oligonucleotide
  Target: ATXN1; (+) strand; PAM type: YTN; PAM sequence: CTA
aagctgaaacacactgttgc

SEQ ID NO: 305464 - DNA, 20 bp, Artificial Sequence
  Description of Artificial Sequence: Synthetic oligonucleotide
  Target: ATXN1; (+) strand; PAM type: YTN; PAM sequence: CTG
aaacacactgttgctttccc

SEQ ID NO: 305465 - DNA, 20 bp, Artificial Sequence
  Description of Artificial Sequence: Synthetic oligonucleotide
  Target: ATXN1; (+) strand; PAM type: YTN; PAM sequence: CTG
ttgctttccccatggctgag

SEQ ID NO: 305466 - DNA, 20 bp, Artificial Sequence
  Description of Artificial Sequence: Synthetic oligonucleotide
  Target: ATXN1; (+) strand; PAM type: YTN; PAM sequence: TTG
ctttccccatggctgagaat

SEQ ID NO: 305467 - DNA, 20 bp, Artificial Sequence
  Description of Artificial Sequence: Synthetic oligonucleotide
  Target: ATXN1; (+) strand; PAM type: YTN; PAM sequence: CTT
tccccatggctgagaatgca

SEQ ID NO: 305468 - DNA, 20 bp, Artificial Sequence
  Description of Artificial Sequence: Synthetic oligonucleotide
  Target: ATXN1; (+) strand; PAM type: YTN; PAM sequence: TTT
ccccatggctgagaatgcag

SEQ ID NO: 305469 - DNA, 20 bp, Artificial Sequence
  Description of Artificial Sequence: Synthetic oligonucleotide
  Target: ATXN1; (+) strand; PAM type: YTN; PAM sequence: TTC
cccatggctgagaatgcagt

SEQ ID NO: 305470 - DNA, 20 bp, Artificial Sequence
  Description of Artificial Sequence: Synthetic oligonucleotide
  Target: ATXN1; (+) strand; PAM type: YTN; PAM sequence: CTG
agaatgcagtgtcagtaaca

SEQ ID NO: 305471 - DNA, 20 bp, Artificial Sequence
  Description of Artificial Sequence: Synthetic oligonucleotide
  Target: ATXN1; (+) strand; PAM type: YTN; PAM sequence: TTT
tctgctctgcttcaaaagat

SEQ ID NO: 305472 - DNA, 20 bp, Artificial Sequence
  Description of Artificial Sequence: Synthetic oligonucleotide
  Target: ATXN1; (+) strand; PAM type: YTN; PAM sequence: TTT
ctgctctgcttcaaaagatc

SEQ ID NO: 305473 - DNA, 20 bp, Artificial Sequence
  Description of Artificial Sequence: Synthetic oligonucleotide
  Target: ATXN1; (+) strand; PAM type: YTN; PAM sequence: TTC
tgctctgcttcaaaagatct

SEQ ID NO: 305474 - DNA, 20 bp, Artificial Sequence
  Description of Artificial Sequence: Synthetic oligonucleotide
  Target: ATXN1; (+) strand; PAM type: YTN; PAM sequence: CTG
ctctgcttcaaaagatctgt

SEQ ID NO: 305475 - DNA, 20 bp, Artificial Sequence
  Description of Artificial Sequence: Synthetic oligonucleotide
  Target: ATXN1; (+) strand; PAM type: YTN; PAM sequence: CTC
tgcttcaaaagatctgttat

SEQ ID NO: 305476 - DNA, 20 bp, Artificial Sequence
  Description of Artificial Sequence: Synthetic oligonucleotide
  Target: ATXN1; (+) strand; PAM type: YTN; PAM sequence: CTG
cttcaaaagatctgttatgt

SEQ ID NO: 305477 - DNA, 20 bp, Artificial Sequence
  Description of Artificial Sequence: Synthetic oligonucleotide
  Target: ATXN1; (+) strand; PAM type: YTN; PAM sequence: CTT
caaaagatctgttatgttta

SEQ ID NO: 305478 - DNA, 20 bp, Artificial Sequence
  Description of Artificial Sequence: Synthetic oligonucleotide
  Target: ATXN1; (+) strand; PAM type: YTN; PAM sequence: TTC
aaaagatctgttatgtttaa

SEQ ID NO: 305479 - DNA, 20 bp, Artificial Sequence
  Description of Artificial Sequence: Synthetic oligonucleotide
  Target: ATXN1; (+) strand; PAM type: YTN; PAM sequence: CTG
ttatgtttaagaatttaaaa

SEQ ID NO: 305480 - DNA, 20 bp, Artificial Sequence
  Description of Artificial Sequence: Synthetic oligonucleotide
  Target: ATXN1; (+) strand; PAM type: YTN; PAM sequence: TTA
tgtttaagaatttaaaacac

SEQ ID NO: 305481 - DNA, 20 bp, Artificial Sequence
  Description of Artificial Sequence: Synthetic oligonucleotide
  Target: ATXN1; (+) strand; PAM type: YTN; PAM sequence: TTT
aagaatttaaaacacacaca

SEQ ID NO: 305482 - DNA, 20 bp, Artificial Sequence
  Description of Artificial Sequence: Synthetic oligonucleotide
  Target: ATXN1; (+) strand; PAM type: YTN; PAM sequence: TTA
agaatttaaaacacacacac

SEQ ID NO: 305483 - DNA, 20 bp, Artificial Sequence
  Description of Artificial Sequence: Synthetic oligonucleotide
  Target: ATXN1; (+) strand; PAM type: YTN; PAM sequence: TTT
aaaacacacacacactctct

SEQ ID NO: 305484 - DNA, 20 bp, Artificial Sequence
  Description of Artificial Sequence: Synthetic oligonucleotide
  Target: ATXN1; (+) strand; PAM type: YTN; PAM sequence: TTA
aaacacacacacactctctc

SEQ ID NO: 305485 - DNA, 20 bp, Artificial Sequence
  Description of Artificial Sequence: Synthetic oligonucleotide
  Target: ATXN1; (+) strand; PAM type: YTN; PAM sequence: CTC
tctctcacacacacgcaaat

SEQ ID NO: 305486 - DNA, 20 bp, Artificial Sequence
  Description of Artificial Sequence: Synthetic oligonucleotide
  Target: ATXN1; (+) strand; PAM type: YTN; PAM sequence: CTC
tctcacacacacgcaaatac

SEQ ID NO: 305487 - DNA, 20 bp, Artificial Sequence
  Description of Artificial Sequence: Synthetic oligonucleotide
  Target: ATXN1; (+) strand; PAM type: YTN; PAM sequence: CTC
tcacacacacgcaaatacag

SEQ ID NO: 305488 - DNA, 20 bp, Artificial Sequence
  Description of Artificial Sequence: Synthetic oligonucleotide
  Target: ATXN1; (+) strand; PAM type: YTN; PAM sequence: CTC
acacacacgcaaatacagaa

SEQ ID NO: 305489 - DNA, 20 bp, Artificial Sequence
  Description of Artificial Sequence: Synthetic oligonucleotide
  Target: ATXN1; (+) strand; PAM type: YTN; PAM sequence: TTT
tctaccaaagaaggtacaag

SEQ ID NO: 305490 - DNA, 20 bp, Artificial Sequence
  Description of Artificial Sequence: Synthetic oligonucleotide
  Target: ATXN1; (+) strand; PAM type: YTN; PAM sequence: TTT
ctaccaaagaaggtacaagg

SEQ ID NO: 305491 - DNA, 20 bp, Artificial Sequence
  Description of Artificial Sequence: Synthetic oligonucleotide
  Target: ATXN1; (+) strand; PAM type: YTN; PAM sequence: TTC
taccaaagaaggtacaaggt

SEQ ID NO: 305492 - DNA, 20 bp, Artificial Sequence
  Description of Artificial Sequence: Synthetic oligonucleotide
  Target: ATXN1; (+) strand; PAM type: YTN; PAM sequence: CTA
ccaaagaaggtacaaggtgt

SEQ ID NO: 305493 - DNA, 20 bp, Artificial Sequence
  Description of Artificial Sequence: Synthetic oligonucleotide
  Target: ATXN1; (+) strand; PAM type: YTN; PAM sequence: TTT
ttacccaacaactctgaatg

SEQ ID NO: 305494 - DNA, 20 bp, Artificial Sequence
  Description of Artificial Sequence: Synthetic oligonucleotide
  Target: ATXN1; (+) strand; PAM type: YTN; PAM sequence: TTT
tacccaacaactctgaatgt

SEQ ID NO: 305495 - DNA, 20 bp, Artificial Sequence
  Description of Artificial Sequence: Synthetic oligonucleotide
  Target: ATXN1; (+) strand; PAM type: YTN; PAM sequence: TTT
acccaacaactctgaatgtg

SEQ ID NO: 305496 - DNA, 20 bp, Artificial Sequence
  Description of Artificial Sequence: Synthetic oligonucleotide
  Target: ATXN1; (+) strand; PAM type: YTN; PAM sequence: TTA
cccaacaactctgaatgtgt

SEQ ID NO: 305497 - DNA, 20 bp, Artificial Sequence
  Description of Artificial Sequence: Synthetic oligonucleotide
  Target: ATXN1; (+) strand; PAM type: YTN; PAM sequence: CTC
tgaatgtgtgtgatcatgcg

SEQ ID NO: 305498 - DNA, 20 bp, Artificial Sequence
  Description of Artificial Sequence: Synthetic oligonucleotide
  Target: ATXN1; (+) strand; PAM type: YTN; PAM sequence: CTG
aatgtgtgtgatcatgcgta

SEQ ID NO: 305499 - DNA, 20 bp, Artificial Sequence
  Description of Artificial Sequence: Synthetic oligonucleotide
  Target: ATXN1; (+) strand; PAM type: YTN; PAM sequence: TTC
tctttaagtactattggtat

SEQ ID NO: 305500 - DNA, 20 bp, Artificial Sequence
  Description of Artificial Sequence: Synthetic oligonucleotide
  Target: ATXN1; (+) strand; PAM type: YTN; PAM sequence: CTC
tttaagtactattggtatgc

SEQ ID NO: 305501 - DNA, 20 bp, Artificial Sequence
  Description of Artificial Sequence: Synthetic oligonucleotide
  Target: ATXN1; (+) strand; PAM type: YTN; PAM sequence: CTT
taagtactattggtatgcta

SEQ ID NO: 305502 - DNA, 20 bp, Artificial Sequence
  Description of Artificial Sequence: Synthetic oligonucleotide
  Target: ATXN1; (+) strand; PAM type: YTN; PAM sequence: TTT
aagtactattggtatgctac

SEQ ID NO: 305503 - DNA, 20 bp, Artificial Sequence
  Description of Artificial Sequence: Synthetic oligonucleotide
  Target: ATXN1; (+) strand; PAM type: YTN; PAM sequence: TTA
agtactattggtatgctaca

SEQ ID NO: 305504 - DNA, 20 bp, Artificial Sequence
  Description of Artificial Sequence: Synthetic oligonucleotide
  Target: ATXN1; (+) strand; PAM type: YTN; PAM sequence: CTA
ttggtatgctacatttaaaa

SEQ ID NO: 305505 - DNA, 20 bp, Artificial Sequence
  Description of Artificial Sequence: Synthetic oligonucleotide
  Target: ATXN1; (+) strand; PAM type: YTN; PAM sequence: TTG
gtatgctacatttaaaatat

SEQ ID NO: 305506 - DNA, 20 bp, Artificial Sequence
  Description of Artificial Sequence: Synthetic oligonucleotide
  Target: ATXN1; (+) strand; PAM type: YTN; PAM sequence: CTA
catttaaaatatttcagact

SEQ ID NO: 305507 - DNA, 20 bp, Artificial Sequence
  Description of Artificial Sequence: Synthetic oligonucleotide
  Target: ATXN1; (+) strand; PAM type: YTN; PAM sequence: TTT
aaaatatttcagactgtgtt

SEQ ID NO: 305508 - DNA, 20 bp, Artificial Sequence
  Description of Artificial Sequence: Synthetic oligonucleotide
  Target: ATXN1; (+) strand; PAM type: YTN; PAM sequence: TTA
aaatatttcagactgtgttt

SEQ ID NO: 305509 - DNA, 20 bp, Artificial Sequence
  Description of Artificial Sequence: Synthetic oligonucleotide
  Target: ATXN1; (+) strand; PAM type: YTN; PAM sequence: TTT
cagactgtgtttccataaac

SEQ ID NO: 305510 - DNA, 20 bp, Artificial Sequence
  Description of Artificial Sequence: Synthetic oligonucleotide
  Target: ATXN1; (+) strand; PAM type: YTN; PAM sequence: TTC
agactgtgtttccataaaca

SEQ ID NO: 305511 - DNA, 20 bp, Artificial Sequence
  Description of Artificial Sequence: Synthetic oligonucleotide
  Target: ATXN1; (+) strand; PAM type: YTN; PAM sequence: CTG
tgtttccataaacatttata

SEQ ID NO: 305512 - DNA, 20 bp, Artificial Sequence
  Description of Artificial Sequence: Synthetic oligonucleotide
  Target: ATXN1; (+) strand; PAM type: YTN; PAM sequence: TTT
ccataaacatttatacagac

SEQ ID NO: 305513 - DNA, 20 bp, Artificial Sequence
  Description of Artificial Sequence: Synthetic oligonucleotide
  Target: ATXN1; (+) strand; PAM type: YTN; PAM sequence: TTC
cataaacatttatacagact

SEQ ID NO: 305514 - DNA, 20 bp, Artificial Sequence
  Description of Artificial Sequence: Synthetic oligonucleotide
  Target: ATXN1; (+) strand; PAM type: YTN; PAM sequence: TTT
atacagacttctcagaaata

SEQ ID NO: 305515 - DNA, 20 bp, Artificial Sequence
  Description of Artificial Sequence: Synthetic oligonucleotide
  Target: ATXN1; (+) strand; PAM type: YTN; PAM sequence: TTA
tacagacttctcagaaataa

SEQ ID NO: 305516 - DNA, 20 bp, Artificial Sequence
  Description of Artificial Sequence: Synthetic oligonucleotide
  Target: ATXN1; (+) strand; PAM type: YTN; PAM sequence: CTT
ctcagaaataaaggagaatt

SEQ ID NO: 305517 - DNA, 20 bp, Artificial Sequence
  Description of Artificial Sequence: Synthetic oligonucleotide
  Target: ATXN1; (+) strand; PAM type: YTN; PAM sequence: TTC
tcagaaataaaggagaattc

SEQ ID NO: 305518 - DNA, 20 bp, Artificial Sequence
  Description of Artificial Sequence: Synthetic oligonucleotide
  Target: ATXN1; (+) strand; PAM type: YTN; PAM sequence: CTC
agaaataaaggagaattcta

SEQ ID NO: 305519 - DNA, 20 bp, Artificial Sequence
  Description of Artificial Sequence: Synthetic oligonucleotide
  Target: ATXN1; (+) strand; PAM type: YTN; PAM sequence: TTC
tactaaggattaaaagtcac

SEQ ID NO: 305520 - DNA, 20 bp, Artificial Sequence
  Description of Artificial Sequence: Synthetic oligonucleotide
  Target: ATXN1; (+) strand; PAM type: YTN; PAM sequence: CTA
ctaaggattaaaagtcactg

SEQ ID NO: 305521 - DNA, 20 bp, Artificial Sequence
  Description of Artificial Sequence: Synthetic oligonucleotide
  Target: ATXN1; (+) strand; PAM type: YTN; PAM sequence: CTA
aggattaaaagtcactgccg

SEQ ID NO: 305522 - DNA, 20 bp, Artificial Sequence
  Description of Artificial Sequence: Synthetic oligonucleotide
  Target: ATXN1; (+) strand; PAM type: YTN; PAM sequence: TTA
aaagtcactgccgtgattta

SEQ ID NO: 305523 - DNA, 20 bp, Artificial Sequence
  Description of Artificial Sequence: Synthetic oligonucleotide
  Target: ATXN1; (+) strand; PAM type: YTN; PAM sequence: CTG
ccgtgatttataagctattt

SEQ ID NO: 305524 - DNA, 20 bp, Artificial Sequence
  Description of Artificial Sequence: Synthetic oligonucleotide
  Target: ATXN1; (+) strand; PAM type: YTN; PAM sequence: TTT
ataagctatttcaactaaac

SEQ ID NO: 305525 - DNA, 20 bp, Artificial Sequence
  Description of Artificial Sequence: Synthetic oligonucleotide
  Target: ATXN1; (+) strand; PAM type: YTN; PAM sequence: TTA
taagctatttcaactaaaca

SEQ ID NO: 305526 - DNA, 20 bp, Artificial Sequence
  Description of Artificial Sequence: Synthetic oligonucleotide
  Target: ATXN1; (+) strand; PAM type: YTN; PAM sequence: CTA
tttcaactaaacattgtaaa

SEQ ID NO: 305527 - DNA, 20 bp, Artificial Sequence
  Description of Artificial Sequence: Synthetic oligonucleotide
  Target: ATXN1; (+) strand; PAM type: YTN; PAM sequence: TTT
caactaaacattgtaaactt

SEQ ID NO: 305528 - DNA, 20 bp, Artificial Sequence
  Description of Artificial Sequence: Synthetic oligonucleotide
  Target: ATXN1; (+) strand; PAM type: YTN; PAM sequence: TTC
aactaaacattgtaaacttt

SEQ ID NO: 305529 - DNA, 20 bp, Artificial Sequence
  Description of Artificial Sequence: Synthetic oligonucleotide
  Target: ATXN1; (+) strand; PAM type: YTN; PAM sequence: CTA
aacattgtaaactttggact

SEQ ID NO: 305530 - DNA, 20 bp, Artificial Sequence
  Description of Artificial Sequence: Synthetic oligonucleotide
  Target: ATXN1; (+) strand; PAM type: YTN; PAM sequence: TTG
taaactttggactatttact

SEQ ID NO: 305531 - DNA, 20 bp, Artificial Sequence
  Description of Artificial Sequence: Synthetic oligonucleotide
  Target: ATXN1; (+) strand; PAM type: YTN; PAM sequence: CTT
tggactatttacttttcagt

SEQ ID NO: 305532 - DNA, 20 bp, Artificial Sequence
  Description of Artificial Sequence: Synthetic oligonucleotide
  Target: ATXN1; (+) strand; PAM type: YTN; PAM sequence: TTT
ggactatttacttttcagtg

SEQ ID NO: 305533 - DNA, 20 bp, Artificial Sequence
  Description of Artificial Sequence: Synthetic oligonucleotide
  Target: ATXN1; (+) strand; PAM type: YTN; PAM sequence: TTG
gactatttacttttcagtgg

SEQ ID NO: 305534 - DNA, 20 bp, Artificial Sequence
  Description of Artificial Sequence: Synthetic oligonucleotide
  Target: ATXN1; (+) strand; PAM type: YTN; PAM sequence: CTA
tttacttttcagtgggagag

SEQ ID NO: 305535 - DNA, 20 bp, Artificial Sequence
  Description of Artificial Sequence: Synthetic oligonucleotide
  Target: ATXN1; (+) strand; PAM type: YTN; PAM sequence: TTT
acttttcagtgggagagatc

SEQ ID NO: 305536 - DNA, 20 bp, Artificial Sequence
  Description of Artificial Sequence: Synthetic oligonucleotide
  Target: ATXN1; (+) strand; PAM type: YTN; PAM sequence: TTA
cttttcagtgggagagatca

SEQ ID NO: 305537 - DNA, 20 bp, Artificial Sequence
  Description of Artificial Sequence: Synthetic oligonucleotide
  Target: ATXN1; (+) strand; PAM type: YTN; PAM sequence: CTT
ttcagtgggagagatcattc

SEQ ID NO: 305538 - DNA, 20 bp, Artificial Sequence
  Description of Artificial Sequence: Synthetic oligonucleotide
  Target: ATXN1; (+) strand; PAM type: YTN; PAM sequence: TTT
tcagtgggagagatcattcc

SEQ ID NO: 305539 - DNA, 20 bp, Artificial Sequence
  Description of Artificial Sequence: Synthetic oligonucleotide
  Target: ATXN1; (+) strand; PAM type: YTN; PAM sequence: TTT
cagtgggagagatcattcct

SEQ ID NO: 305540 - DNA, 20 bp, Artificial Sequence
  Description of Artificial Sequence: Synthetic oligonucleotide
  Target: ATXN1; (+) strand; PAM type: YTN; PAM sequence: TTC
agtgggagagatcattcctt

SEQ ID NO: 305541 - DNA, 20 bp, Artificial Sequence
  Description of Artificial Sequence: Synthetic oligonucleotide
  Target: ATXN1; (+) strand; PAM type: YTN; PAM sequence: TTC
cttccagagatagagtaaca

SEQ ID NO: 305542 - DNA, 20 bp, Artificial Sequence
  Description of Artificial Sequence: Synthetic oligonucleotide
  Target: ATXN1; (+) strand; PAM type: YTN; PAM sequence: CTT
ccagagatagagtaacatac

SEQ ID NO: 305543 - DNA, 20 bp, Artificial Sequence
  Description of Artificial Sequence: Synthetic oligonucleotide
  Target: ATXN1; (+) strand; PAM type: YTN; PAM sequence: TTC
cagagatagagtaacatact

SEQ ID NO: 305544 - DNA, 20 bp, Artificial Sequence
  Description of Artificial Sequence: Synthetic oligonucleotide
  Target: ATXN1; (+) strand; PAM type: YTN; PAM sequence: CTA
tattatcatttttcctactt

SEQ ID NO: 305545 - DNA, 20 bp, Artificial Sequence
  Description of Artificial Sequence: Synthetic oligonucleotide
  Target: ATXN1; (+) strand; PAM type: YTN; PAM sequence: TTA
tcatttttcctacttttaag

SEQ ID NO: 305546 - DNA, 20 bp, Artificial Sequence
  Description of Artificial Sequence: Synthetic oligonucleotide
  Target: ATXN1; (+) strand; PAM type: YTN; PAM sequence: TTT
ttcctacttttaagtttcca

SEQ ID NO: 305547 - DNA, 20 bp, Artificial Sequence
  Description of Artificial Sequence: Synthetic oligonucleotide
  Target: ATXN1; (+) strand; PAM type: YTN; PAM sequence: TTT
tcctacttttaagtttccag

SEQ ID NO: 305548 - DNA, 20 bp, Artificial Sequence
  Description of Artificial Sequence: Synthetic oligonucleotide
  Target: ATXN1; (+) strand; PAM type: YTN; PAM sequence: TTT
cctacttttaagtttccagg

SEQ ID NO: 305549 - DNA, 20 bp, Artificial Sequence
  Description of Artificial Sequence: Synthetic oligonucleotide
  Target: ATXN1; (+) strand; PAM type: YTN; PAM sequence: TTC
ctacttttaagtttccaggt

SEQ ID NO: 305550 - DNA, 20 bp, Artificial Sequence
  Description of Artificial Sequence: Synthetic oligonucleotide
  Target: ATXN1; (+) strand; PAM type: YTN; PAM sequence: CTA
cttttaagtttccaggtgta

SEQ ID NO: 305551 - DNA, 20 bp, Artificial Sequence
  Description of Artificial Sequence: Synthetic oligonucleotide
  Target: ATXN1; (+) strand; PAM type: YTN; PAM sequence: CTT
ttaagtttccaggtgtaaca

SEQ ID NO: 305552 - DNA, 20 bp, Artificial Sequence
  Description of Artificial Sequence: Synthetic oligonucleotide
  Target: ATXN1; (+) strand; PAM type: YTN; PAM sequence: TTT
taagtttccaggtgtaacat

SEQ ID NO: 305553 - DNA, 20 bp, Artificial Sequence
  Description of Artificial Sequence: Synthetic oligonucleotide
  Target: ATXN1; (+) strand; PAM type: YTN; PAM sequence: TTT
aagtttccaggtgtaacatc

SEQ ID NO: 305554 - DNA, 20 bp, Artificial Sequence
  Description of Artificial Sequence: Synthetic oligonucleotide
  Target: ATXN1; (+) strand; PAM type: YTN; PAM sequence: TTA
agtttccaggtgtaacatct

SEQ ID NO: 305555 - DNA, 20 bp, Artificial Sequence
  Description of Artificial Sequence: Synthetic oligonucleotide
  Target: ATXN1; (+) strand; PAM type: YTN; PAM sequence: TTT
ccaggtgtaacatctctggg

SEQ ID NO: 305556 - DNA, 20 bp, Artificial Sequence
  Description of Artificial Sequence: Synthetic oligonucleotide
  Target: ATXN1; (+) strand; PAM type: YTN; PAM sequence: TTC
caggtgtaacatctctgggg

SEQ ID NO: 305557 - DNA, 20 bp, Artificial Sequence
  Description of Artificial Sequence: Synthetic oligonucleotide
  Target: ATXN1; (+) strand; PAM type: YTN; PAM sequence: CTC
tggggacattttcattttat

SEQ ID NO: 305558 - DNA, 20 bp, Artificial Sequence
  Description of Artificial Sequence: Synthetic oligonucleotide
  Target: ATXN1; (+) strand; PAM type: YTN; PAM sequence: CTG
gggacattttcattttatta

SEQ ID NO: 305559 - DNA, 20 bp, Artificial Sequence
  Description of Artificial Sequence: Synthetic oligonucleotide
  Target: ATXN1; (+) strand; PAM type: YTN; PAM sequence: TTT
tcattttattaaaaaataat

SEQ ID NO: 305560 - DNA, 20 bp, Artificial Sequence
  Description of Artificial Sequence: Synthetic oligonucleotide
  Target: ATXN1; (+) strand; PAM type: YTN; PAM sequence: TTT
cattttattaaaaaataata

SEQ ID NO: 305561 - DNA, 20 bp, Artificial Sequence
  Description of Artificial Sequence: Synthetic oligonucleotide
  Target: ATXN1; (+) strand; PAM type: YTN; PAM sequence: TTC
attttattaaaaaataataa

SEQ ID NO: 305562 - DNA, 20 bp, Artificial Sequence
  Description of Artificial Sequence: Synthetic oligonucleotide
  Target: ATXN1; (+) strand; PAM type: YTN; PAM sequence: TTT
tattaaaaaataataatttt

SEQ ID NO: 305563 - DNA, 20 bp, Artificial Sequence
  Description of Artificial Sequence: Synthetic oligonucleotide
  Target: ATXN1; (+) strand; PAM type: YTN; PAM sequence: TTT
attaaaaaataataattttt

SEQ ID NO: 305564 - DNA, 20 bp, Artificial Sequence
  Description of Artificial Sequence: Synthetic oligonucleotide
  Target: ATXN1; (+) strand; PAM type: YTN; PAM sequence: TTA
ttaaaaaataataatttttg

SEQ ID NO: 305565 - DNA, 20 bp, Artificial Sequence
  Description of Artificial Sequence: Synthetic oligonucleotide
  Target: ATXN1; (+) strand; PAM type: YTN; PAM sequence: TTA
aaaaataataatttttgtat

SEQ ID NO: 305566 - DNA, 20 bp, Artificial Sequence
  Description of Artificial Sequence: Synthetic oligonucleotide
  Target: ATXN1; (+) strand; PAM type: YTN; PAM sequence: TTT
ttgtatgatcctttaaacaa

SEQ ID NO: 305567 - DNA, 20 bp, Artificial Sequence
  Description of Artificial Sequence: Synthetic oligonucleotide
  Target: ATXN1; (+) strand; PAM type: YTN; PAM sequence: TTT
tgtatgatcctttaaacaac

SEQ ID NO: 305568 - DNA, 20 bp, Artificial Sequence
  Description of Artificial Sequence: Synthetic oligonucleotide
  Target: ATXN1; (+) strand; PAM type: YTN; PAM sequence: TTT
gtatgatcctttaaacaaca

SEQ ID NO: 305569 - DNA, 20 bp, Artificial Sequence
  Description of Artificial Sequence: Synthetic oligonucleotide
  Target: ATXN1; (+) strand; PAM type: YTN; PAM sequence: TTG
tatgatcctttaaacaacaa

SEQ ID NO: 305570 - DNA, 20 bp, Artificial Sequence
  Description of Artificial Sequence: Synthetic oligonucleotide
  Target: ATXN1; (+) strand; PAM type: YTN; PAM sequence: CTT
taaacaacaatctatccttc

SEQ ID NO: 305571 - DNA, 20 bp, Artificial Sequence
  Description of Artificial Sequence: Synthetic oligonucleotide
  Target: ATXN1; (+) strand; PAM type: YTN; PAM sequence: TTT
aaacaacaatctatccttct

SEQ ID NO: 305572 - DNA, 20 bp, Artificial Sequence
  Description of Artificial Sequence: Synthetic oligonucleotide
  Target: ATXN1; (+) strand; PAM type: YTN; PAM sequence: TTA
aacaacaatctatccttctg

SEQ ID NO: 305573 - DNA, 20 bp, Artificial Sequence
  Description of Artificial Sequence: Synthetic oligonucleotide
  Target: ATXN1; (+) strand; PAM type: YTN; PAM sequence: CTA
tccttctgcagttgaaatga

SEQ ID NO: 305574 - DNA, 20 bp, Artificial Sequence
  Description of Artificial Sequence: Synthetic oligonucleotide
  Target: ATXN1; (+) strand; PAM type: YTN; PAM sequence: CTT
ctgcagttgaaatgagttca

SEQ ID NO: 305575 - DNA, 20 bp, Artificial Sequence
  Description of Artificial Sequence: Synthetic oligonucleotide
  Target: ATXN1; (+) strand; PAM type: YTN; PAM sequence: TTC
tgcagttgaaatgagttcaa

SEQ ID NO: 305576 - DNA, 20 bp, Artificial Sequence
  Description of Artificial Sequence: Synthetic oligonucleotide
  Target: ATXN1; (+) strand; PAM type: YTN; PAM sequence: CTG
cagttgaaatgagttcaact

SEQ ID NO: 305577 - DNA, 20 bp, Artificial Sequence
  Description of Artificial Sequence: Synthetic oligonucleotide
  Target: ATXN1; (+) strand; PAM type: YTN; PAM sequence: TTG
aaatgagttcaactacccac

SEQ ID NO: 305578 - DNA, 20 bp, Artificial Sequence
  Description of Artificial Sequence: Synthetic oligonucleotide
  Target: ATXN1; (+) strand; PAM type: YTN; PAM sequence: TTC
aactacccacagtcagctta

SEQ ID NO: 305579 - DNA, 20 bp, Artificial Sequence
  Description of Artificial Sequence: Synthetic oligonucleotide
  Target: ATXN1; (+) strand; PAM type: YTN; PAM sequence: CTA
cccacagtcagcttacacat

SEQ ID NO: 305580 - DNA, 20 bp, Artificial Sequence
  Description of Artificial Sequence: Synthetic oligonucleotide
  Target: ATXN1; (+) strand; PAM type: YTN; PAM sequence: CTT
acacataacttattactata

SEQ ID NO: 305581 - DNA, 20 bp, Artificial Sequence
  Description of Artificial Sequence: Synthetic oligonucleotide
  Target: ATXN1; (+) strand; PAM type: YTN; PAM sequence: TTA
cacataacttattactataa

SEQ ID NO: 305582 - DNA, 20 bp, Artificial Sequence
  Description of Artificial Sequence: Synthetic oligonucleotide
  Target: ATXN1; (+) strand; PAM type: YTN; PAM sequence: CTT
attactataaatcaactata

SEQ ID NO: 305583 - DNA, 20 bp, Artificial Sequence
  Description of Artificial Sequence: Synthetic oligonucleotide
  Target: ATXN1; (+) strand; PAM type: YTN; PAM sequence: TTA
ttactataaatcaactataa

SEQ ID NO: 305584 - DNA, 20 bp, Artificial Sequence
  Description of Artificial Sequence: Synthetic oligonucleotide
  Target: ATXN1; (+) strand; PAM type: YTN; PAM sequence: TTA
ctataaatcaactataaaaa

SEQ ID NO: 305585 - DNA, 20 bp, Artificial Sequence
  Description of Artificial Sequence: Synthetic oligonucleotide
  Target: ATXN1; (+) strand; PAM type: YTN; PAM sequence: CTA
taaatcaactataaaaacta

SEQ ID NO: 305586 - DNA, 20 bp, Artificial Sequence
  Description of Artificial Sequence: Synthetic oligonucleotide
  Target: ATXN1; (+) strand; PAM type: YTN; PAM sequence: CTA
taaaaactaagctacaatca

SEQ ID NO: 305587 - DNA, 20 bp, Artificial Sequence
  Description of Artificial Sequence: Synthetic oligonucleotide
  Target: ATXN1; (+) strand; PAM type: YTN; PAM sequence: CTA
agctacaatcattacttaat

SEQ ID NO: 305588 - DNA, 20 bp, Artificial Sequence
  Description of Artificial Sequence: Synthetic oligonucleotide
  Target: ATXN1; (+) strand; PAM type: YTN; PAM sequence: CTA
caatcattacttaatcctaa

SEQ ID NO: 305589 - DNA, 20 bp, Artificial Sequence
  Description of Artificial Sequence: Synthetic oligonucleotide
  Target: ATXN1; (+) strand; PAM type: YTN; PAM sequence: TTA
cttaatcctaaaaggaggag

SEQ ID NO: 305590 - DNA, 20 bp, Artificial Sequence
  Description of Artificial Sequence: Synthetic oligonucleotide
  Target: ATXN1; (+) strand; PAM type: YTN; PAM sequence: CTT
aatcctaaaaggaggaggaa

SEQ ID NO: 305591 - DNA, 20 bp, Artificial Sequence
  Description of Artificial Sequence: Synthetic oligonucleotide
  Target: ATXN1; (+) strand; PAM type: YTN; PAM sequence: TTA
atcctaaaaggaggaggaag

SEQ ID NO: 305592 - DNA, 20 bp, Artificial Sequence
  Description of Artificial Sequence: Synthetic oligonucleotide
  Target: ATXN1; (+) strand; PAM type: YTN; PAM sequence: CTA
aaaggaggaggaagagacaa

SEQ ID NO: 305593 - DNA, 20 bp, Artificial Sequence
  Description of Artificial Sequence: Synthetic oligonucleotide
  Target: ATXN1; (+) strand; PAM type: YTN; PAM sequence: CTC
aagtacaatcttttatagat

SEQ ID NO: 305594 - DNA, 20 bp, Artificial Sequence
  Description of Artificial Sequence: Synthetic oligonucleotide
  Target: ATXN1; (+) strand; PAM type: YTN; PAM sequence: CTT
ttatagataaaatcatgttc

SEQ ID NO: 305595 - DNA, 20 bp, Artificial Sequence
  Description of Artificial Sequence: Synthetic oligonucleotide
  Target: ATXN1; (+) strand; PAM type: YTN; PAM sequence: TTT
tatagataaaatcatgttct

SEQ ID NO: 305596 - DNA, 20 bp, Artificial Sequence
  Description of Artificial Sequence: Synthetic oligonucleotide
  Target: ATXN1; (+) strand; PAM type: YTN; PAM sequence: TTT
atagataaaatcatgttcta

SEQ ID NO: 305597 - DNA, 20 bp, Artificial Sequence
  Description of Artificial Sequence: Synthetic oligonucleotide
  Target: ATXN1; (+) strand; PAM type: YTN; PAM sequence: TTA
tagataaaatcatgttctat

SEQ ID NO: 305598 - DNA, 20 bp, Artificial Sequence
  Description of Artificial Sequence: Synthetic oligonucleotide
  Target: ATXN1; (+) strand; PAM type: YTN; PAM sequence: TTC
tatatcacccctttggataa

SEQ ID NO: 305599 - DNA, 20 bp, Artificial Sequence
  Description of Artificial Sequence: Synthetic oligonucleotide
  Target: ATXN1; (+) strand; PAM type: YTN; PAM sequence: CTA
tatcacccctttggataaac

SEQ ID NO: 305600 - DNA, 20 bp, Artificial Sequence
  Description of Artificial Sequence: Synthetic oligonucleotide
  Target: ATXN1; (+) strand; PAM type: YTN; PAM sequence: CTT
tggataaaccttttatttat

SEQ ID NO: 305601 - DNA, 20 bp, Artificial Sequence
  Description of Artificial Sequence: Synthetic oligonucleotide
  Target: ATXN1; (+) strand; PAM type: YTN; PAM sequence: TTT
ggataaaccttttatttatg

SEQ ID NO: 305602 - DNA, 20 bp, Artificial Sequence
  Description of Artificial Sequence: Synthetic oligonucleotide
  Target: ATXN1; (+) strand; PAM type: YTN; PAM sequence: TTG
gataaaccttttatttatga

SEQ ID NO: 305603 - DNA, 20 bp, Artificial Sequence
  Description of Artificial Sequence: Synthetic oligonucleotide
  Target: ATXN1; (+) strand; PAM type: YTN; PAM sequence: CTT
ttatttatgaatctagcgca

SEQ ID NO: 305604 - DNA, 20 bp, Artificial Sequence
  Description of Artificial Sequence: Synthetic oligonucleotide
  Target: ATXN1; (+) strand; PAM type: YTN; PAM sequence: TTT
tatttatgaatctagcgcat

SEQ ID NO: 305605 - DNA, 20 bp, Artificial Sequence
  Description of Artificial Sequence: Synthetic oligonucleotide
  Target: ATXN1; (+) strand; PAM type: YTN; PAM sequence: TTT
atttatgaatctagcgcatt

SEQ ID NO: 305606 - DNA, 20 bp, Artificial Sequence
  Description of Artificial Sequence: Synthetic oligonucleotide
  Target: ATXN1; (+) strand; PAM type: YTN; PAM sequence: TTA
tttatgaatctagcgcattt

SEQ ID NO: 305607 - DNA, 20 bp, Artificial Sequence
  Description of Artificial Sequence: Synthetic oligonucleotide
  Target: ATXN1; (+) strand; PAM type: YTN; PAM sequence: TTT
atgaatctagcgcatttccc

SEQ ID NO: 305608 - DNA, 20 bp, Artificial Sequence
  Description of Artificial Sequence: Synthetic oligonucleotide
  Target: ATXN1; (+) strand; PAM type: YTN; PAM sequence: TTA
tgaatctagcgcatttcccc

SEQ ID NO: 305609 - DNA, 20 bp, Artificial Sequence
  Description of Artificial Sequence: Synthetic oligonucleotide
  Target: ATXN1; (+) strand; PAM type: YTN; PAM sequence: CTA
gcgcatttcccctcgtaggc

SEQ ID NO: 305610 - DNA, 20 bp, Artificial Sequence
  Description of Artificial Sequence: Synthetic oligonucleotide
  Target: ATXN1; (+) strand; PAM type: YTN; PAM sequence: TTT
cccctcgtaggctaaatttc

SEQ ID NO: 305611 - DNA, 20 bp, Artificial Sequence
  Description of Artificial Sequence: Synthetic oligonucleotide
  Target: ATXN1; (+) strand; PAM type: YTN; PAM sequence: TTC
ccctcgtaggctaaatttcc

SEQ ID NO: 305612 - DNA, 20 bp, Artificial Sequence
  Description of Artificial Sequence: Synthetic oligonucleotide
  Target: ATXN1; (+) strand; PAM type: YTN; PAM sequence: CTC
gtaggctaaatttccttaag

SEQ ID NO: 305613 - DNA, 20 bp, Artificial Sequence
  Description of Artificial Sequence: Synthetic oligonucleotide
  Target: ATXN1; (+) strand; PAM type: YTN; PAM sequence: CTA
aatttccttaagcttttctg

SEQ ID NO: 305614 - DNA, 20 bp, Artificial Sequence
  Description of Artificial Sequence: Synthetic oligonucleotide
  Target: ATXN1; (+) strand; PAM type: YTN; PAM sequence: TTT
ccttaagcttttctggacaa

SEQ ID NO: 305615 - DNA, 20 bp, Artificial Sequence
  Description of Artificial Sequence: Synthetic oligonucleotide
  Target: ATXN1; (+) strand; PAM type: YTN; PAM sequence: TTC
cttaagcttttctggacaaa

SEQ ID NO: 305616 - DNA, 20 bp, Artificial Sequence
  Description of Artificial Sequence: Synthetic oligonucleotide
  Target: ATXN1; (+) strand; PAM type: YTN; PAM sequence: CTT
aagcttttctggacaaattc

SEQ ID NO: 305617 - DNA, 20 bp, Artificial Sequence
  Description of Artificial Sequence: Synthetic oligonucleotide
  Target: ATXN1; (+) strand; PAM type: YTN; PAM sequence: TTA
agcttttctggacaaattcc

SEQ ID NO: 305618 - DNA, 20 bp, Artificial Sequence
  Description of Artificial Sequence: Synthetic oligonucleotide
  Target: ATXN1; (+) strand; PAM type: YTN; PAM sequence: CTT
ttctggacaaattccctgca

SEQ ID NO: 305619 - DNA, 20 bp, Artificial Sequence
  Description of Artificial Sequence: Synthetic oligonucleotide
  Target: ATXN1; (+) strand; PAM type: YTN; PAM sequence: TTT
tctggacaaattccctgcat

SEQ ID NO: 305620 - DNA, 20 bp, Artificial Sequence
  Description of Artificial Sequence: Synthetic oligonucleotide
  Target: ATXN1; (+) strand; PAM type: YTN; PAM sequence: TTT
ctggacaaattccctgcatt

SEQ ID NO: 305621 - DNA, 20 bp, Artificial Sequence
  Description of Artificial Sequence: Synthetic oligonucleotide
  Target: ATXN1; (+) strand; PAM type: YTN; PAM sequence: TTC
tggacaaattccctgcattc

SEQ ID NO: 305622 - DNA, 20 bp, Artificial Sequence
  Description of Artificial Sequence: Synthetic oligonucleotide
  Target: ATXN1; (+) strand; PAM type: YTN; PAM sequence: CTG
gacaaattccctgcattcaa

SEQ ID NO: 305623 - DNA, 20 bp, Artificial Sequence
  Description of Artificial Sequence: Synthetic oligonucleotide
  Target: ATXN1; (+) strand; PAM type: YTN; PAM sequence: TTC
cctgcattcaacagaataag

SEQ ID NO: 305624 - DNA, 20 bp, Artificial Sequence
  Description of Artificial Sequence: Synthetic oligonucleotide
  Target: ATXN1; (+) strand; PAM type: YTN; PAM sequence: CTG
cattcaacagaataagttcc

SEQ ID NO: 305625 - DNA, 20 bp, Artificial Sequence
  Description of Artificial Sequence: Synthetic oligonucleotide
  Target: ATXN1; (+) strand; PAM type: YTN; PAM sequence: TTC
aacagaataagttccaatgt

SEQ ID NO: 305626 - DNA, 20 bp, Artificial Sequence
  Description of Artificial Sequence: Synthetic oligonucleotide
  Target: ATXN1; (+) strand; PAM type: YTN; PAM sequence: TTC
caatgtttagtcagaaaaga

SEQ ID NO: 305627 - DNA, 20 bp, Artificial Sequence
  Description of Artificial Sequence: Synthetic oligonucleotide
  Target: ATXN1; (+) strand; PAM type: YTN; PAM sequence: TTT
agtcagaaaagagactctgg

SEQ ID NO: 305628 - DNA, 20 bp, Artificial Sequence
  Description of Artificial Sequence: Synthetic oligonucleotide
  Target: ATXN1; (+) strand; PAM type: YTN; PAM sequence: TTA
gtcagaaaagagactctgga

SEQ ID NO: 305629 - DNA, 20 bp, Artificial Sequence
  Description of Artificial Sequence: Synthetic oligonucleotide
  Target: ATXN1; (+) strand; PAM type: YTN; PAM sequence: CTC
tggagcattaagataattac

SEQ ID NO: 305630 - DNA, 20 bp, Artificial Sequence
  Description of Artificial Sequence: Synthetic oligonucleotide
  Target: ATXN1; (+) strand; PAM type: YTN; PAM sequence: CTG
gagcattaagataattacac

SEQ ID NO: 305631 - DNA, 20 bp, Artificial Sequence
  Description of Artificial Sequence: Synthetic oligonucleotide
  Target: ATXN1; (+) strand; PAM type: YTN; PAM sequence: TTA
agataattacacaatttcaa

SEQ ID NO: 305632 - DNA, 20 bp, Artificial Sequence
  Description of Artificial Sequence: Synthetic oligonucleotide
  Target: ATXN1; (+) strand; PAM type: YTN; PAM sequence: TTA
cacaatttcaacttctaagt

SEQ ID NO: 305633 - DNA, 20 bp, Artificial Sequence
  Description of Artificial Sequence: Synthetic oligonucleotide
  Target: ATXN1; (+) strand; PAM type: YTN; PAM sequence: TTT
caacttctaagtatatatat

SEQ ID NO: 305634 - DNA, 20 bp, Artificial Sequence
  Description of Artificial Sequence: Synthetic oligonucleotide
  Target: ATXN1; (+) strand; PAM type: YTN; PAM sequence: TTC
aacttctaagtatatatatt

SEQ ID NO: 305635 - DNA, 20 bp, Artificial Sequence
  Description of Artificial Sequence: Synthetic oligonucleotide
  Target: ATXN1; (+) strand; PAM type: YTN; PAM sequence: CTT
ctaagtatatatatttttaa

SEQ ID NO: 305636 - DNA, 20 bp, Artificial Sequence
  Description of Artificial Sequence: Synthetic oligonucleotide
  Target: ATXN1; (+) strand; PAM type: YTN; PAM sequence: TTC
taagtatatatatttttaaa

SEQ ID NO: 305637 - DNA, 20 bp, Artificial Sequence
  Description of Artificial Sequence: Synthetic oligonucleotide
  Target: ATXN1; (+) strand; PAM type: YTN; PAM sequence: CTA
agtatatatatttttaaaat

SEQ ID NO: 305638 - DNA, 20 bp, Artificial Sequence
  Description of Artificial Sequence: Synthetic oligonucleotide
  Target: ATXN1; (+) strand; PAM type: YTN; PAM sequence: TTT
ttaaaattaataacatagtg

SEQ ID NO: 305639 - DNA, 20 bp, Artificial Sequence
  Description of Artificial Sequence: Synthetic oligonucleotide
  Target: ATXN1; (+) strand; PAM type: YTN; PAM sequence: TTT
taaaattaataacatagtgc

SEQ ID NO: 305640 - DNA, 20 bp, Artificial Sequence
  Description of Artificial Sequence: Synthetic oligonucleotide
  Target: ATXN1; (+) strand; PAM type: YTN; PAM sequence: TTT
aaaattaataacatagtgca

SEQ ID NO: 305641 - DNA, 20 bp, Artificial Sequence
  Description of Artificial Sequence: Synthetic oligonucleotide
  Target: ATXN1; (+) strand; PAM type: YTN; PAM sequence: TTA
aaattaataacatagtgcac

SEQ ID NO: 305642 - DNA, 20 bp, Artificial Sequence
  Description of Artificial Sequence: Synthetic oligonucleotide
  Target: ATXN1; (+) strand; PAM type: YTN; PAM sequence: TTA
ataacatagtgcacttcctt

SEQ ID NO: 305643 - DNA, 20 bp, Artificial Sequence
  Description of Artificial Sequence: Synthetic oligonucleotide
  Target: ATXN1; (+) strand; PAM type: YTN; PAM sequence: CTT
ccttacttagaaggaaattt

SEQ ID NO: 305644 - DNA, 20 bp, Artificial Sequence
  Description of Artificial Sequence: Synthetic oligonucleotide
  Target: ATXN1; (+) strand; PAM type: YTN; PAM sequence: TTC
cttacttagaaggaaattta

SEQ ID NO: 305645 - DNA, 20 bp, Artificial Sequence
  Description of Artificial Sequence: Synthetic oligonucleotide
  Target: ATXN1; (+) strand; PAM type: YTN; PAM sequence: CTT
acttagaaggaaatttaaat

SEQ ID NO: 305646 - DNA, 20 bp, Artificial Sequence
  Description of Artificial Sequence: Synthetic oligonucleotide
  Target: ATXN1; (+) strand; PAM type: YTN; PAM sequence: TTA
cttagaaggaaatttaaatt

SEQ ID NO: 305647 - DNA, 20 bp, Artificial Sequence
  Description of Artificial Sequence: Synthetic oligonucleotide
  Target: ATXN1; (+) strand; PAM type: YTN; PAM sequence: CTT
agaaggaaatttaaattaca

SEQ ID NO: 305648 - DNA, 20 bp, Artificial Sequence
  Description of Artificial Sequence: Synthetic oligonucleotide
  Target: ATXN1; (+) strand; PAM type: YTN; PAM sequence: TTA
gaaggaaatttaaattacaa

SEQ ID NO: 305649 - DNA, 20 bp, Artificial Sequence
  Description of Artificial Sequence: Synthetic oligonucleotide
  Target: ATXN1; (+) strand; PAM type: YTN; PAM sequence: TTT
aaattacaaagaatctgaca

SEQ ID NO: 305650 - DNA, 20 bp, Artificial Sequence
  Description of Artificial Sequence: Synthetic oligonucleotide
  Target: ATXN1; (+) strand; PAM type: YTN; PAM sequence: TTA
aattacaaagaatctgacat

SEQ ID NO: 305651 - DNA, 20 bp, Artificial Sequence
  Description of Artificial Sequence: Synthetic oligonucleotide
  Target: ATXN1; (+) strand; PAM type: YTN; PAM sequence: TTA
caaagaatctgacattttga

SEQ ID NO: 305652 - DNA, 20 bp, Artificial Sequence
  Description of Artificial Sequence: Synthetic oligonucleotide
  Target: ATXN1; (+) strand; PAM type: YTN; PAM sequence: CTG
acattttgaaatttctgaac

SEQ ID NO: 305653 - DNA, 20 bp, Artificial Sequence
  Description of Artificial Sequence: Synthetic oligonucleotide
  Target: ATXN1; (+) strand; PAM type: YTN; PAM sequence: TTT
tgaaatttctgaacccaaaa

SEQ ID NO: 305654 - DNA, 20 bp, Artificial Sequence
  Description of Artificial Sequence: Synthetic oligonucleotide
  Target: ATXN1; (+) strand; PAM type: YTN; PAM sequence: TTT
gaaatttctgaacccaaaag

SEQ ID NO: 305655 - DNA, 20 bp, Artificial Sequence
  Description of Artificial Sequence: Synthetic oligonucleotide
  Target: ATXN1; (+) strand; PAM type: YTN; PAM sequence: TTG
aaatttctgaacccaaaagc

SEQ ID NO: 305656 - DNA, 20 bp, Artificial Sequence
  Description of Artificial Sequence: Synthetic oligonucleotide
  Target: ATXN1; (+) strand; PAM type: YTN; PAM sequence: TTT
ctgaacccaaaagccattaa

SEQ ID NO: 305657 - DNA, 20 bp, Artificial Sequence
  Description of Artificial Sequence: Synthetic oligonucleotide
  Target: ATXN1; (+) strand; PAM type: YTN; PAM sequence: TTC
tgaacccaaaagccattaaa

SEQ ID NO: 305658 - DNA, 20 bp, Artificial Sequence
  Description of Artificial Sequence: Synthetic oligonucleotide
  Target: ATXN1; (+) strand; PAM type: YTN; PAM sequence: CTG
aacccaaaagccattaaaaa

SEQ ID NO: 305659 - DNA, 20 bp, Artificial Sequence
  Description of Artificial Sequence: Synthetic oligonucleotide
  Target: ATXN1; (+) strand; PAM type: YTN; PAM sequence: TTA
aaaaaatagcccatgagcca

SEQ ID NO: 305660 - DNA, 20 bp, Artificial Sequence
  Description of Artificial Sequence: Synthetic oligonucleotide
  Target: ATXN1; (+) strand; PAM type: YTN; PAM sequence: CTT
cactaaatgtttatcacagt

SEQ ID NO: 305661 - DNA, 20 bp, Artificial Sequence
  Description of Artificial Sequence: Synthetic oligonucleotide
  Target: ATXN1; (+) strand; PAM type: YTN; PAM sequence: TTC
actaaatgtttatcacagtg

SEQ ID NO: 305662 - DNA, 20 bp, Artificial Sequence
  Description of Artificial Sequence: Synthetic oligonucleotide
  Target: ATXN1; (+) strand; PAM type: YTN; PAM sequence: CTA
aatgtttatcacagtgtaac

SEQ ID NO: 305663 - DNA, 20 bp, Artificial Sequence
  Description of Artificial Sequence: Synthetic oligonucleotide
  Target: ATXN1; (+) strand; PAM type: YTN; PAM sequence: TTT
atcacagtgtaacatttcca

SEQ ID NO: 305664 - DNA, 20 bp, Artificial Sequence
  Description of Artificial Sequence: Synthetic oligonucleotide
  Target: ATXN1; (+) strand; PAM type: YTN; PAM sequence: TTA
tcacagtgtaacatttccac

SEQ ID NO: 305665 - DNA, 20 bp, Artificial Sequence
  Description of Artificial Sequence: Synthetic oligonucleotide
  Target: ATXN1; (+) strand; PAM type: YTN; PAM sequence: TTT
ccacagtatgaaaagtttct

SEQ ID NO: 305666 - DNA, 20 bp, Artificial Sequence
  Description of Artificial Sequence: Synthetic oligonucleotide
  Target: ATXN1; (+) strand; PAM type: YTN; PAM sequence: TTC
cacagtatgaaaagtttctg

SEQ ID NO: 305667 - DNA, 20 bp, Artificial Sequence
  Description of Artificial Sequence: Synthetic oligonucleotide
  Target: ATXN1; (+) strand; PAM type: YTN; PAM sequence: TTT
ctggctatcatgcaatttta

SEQ ID NO: 305668 - DNA, 20 bp, Artificial Sequence
  Description of Artificial Sequence: Synthetic oligonucleotide
  Target: ATXN1; (+) strand; PAM type: YTN; PAM sequence: TTC
tggctatcatgcaattttaa

SEQ ID NO: 305669 - DNA, 20 bp, Artificial Sequence
  Description of Artificial Sequence: Synthetic oligonucleotide
  Target: ATXN1; (+) strand; PAM type: YTN; PAM sequence: CTG
gctatcatgcaattttaaat

SEQ ID NO: 305670 - DNA, 20 bp, Artificial Sequence
  Description of Artificial Sequence: Synthetic oligonucleotide
  Target: ATXN1; (+) strand; PAM type: YTN; PAM sequence: CTA
tcatgcaattttaaattcat

SEQ ID NO: 305671 - DNA, 20 bp, Artificial Sequence
  Description of Artificial Sequence: Synthetic oligonucleotide
  Target: ATXN1; (+) strand; PAM type: YTN; PAM sequence: TTT
taaattcatgtccattttca

SEQ ID NO: 305672 - DNA, 20 bp, Artificial Sequence
  Description of Artificial Sequence: Synthetic oligonucleotide
  Target: ATXN1; (+) strand; PAM type: YTN; PAM sequence: TTT
aaattcatgtccattttcac

SEQ ID NO: 305673 - DNA, 20 bp, Artificial Sequence
  Description of Artificial Sequence: Synthetic oligonucleotide
  Target: ATXN1; (+) strand; PAM type: YTN; PAM sequence: TTA
aattcatgtccattttcact

SEQ ID NO: 305674 - DNA, 20 bp, Artificial Sequence
  Description of Artificial Sequence: Synthetic oligonucleotide
  Target: ATXN1; (+) strand; PAM type: YTN; PAM sequence: TTC
atgtccattttcactcgact

SEQ ID NO: 305675 - DNA, 20 bp, Artificial Sequence
  Description of Artificial Sequence: Synthetic oligonucleotide
  Target: ATXN1; (+) strand; PAM type: YTN; PAM sequence: TTT
tcactcgactgtgttttttt

SEQ ID NO: 305676 - DNA, 20 bp, Artificial Sequence
  Description of Artificial Sequence: Synthetic oligonucleotide
  Target: ATXN1; (+) strand; PAM type: YTN; PAM sequence: TTT
cactcgactgtgttttttta

SEQ ID NO: 305677 - DNA, 20 bp, Artificial Sequence
  Description of Artificial Sequence: Synthetic oligonucleotide
  Target: ATXN1; (+) strand; PAM type: YTN; PAM sequence: TTC
actcgactgtgtttttttaa

SEQ ID NO: 305678 - DNA, 20 bp, Artificial Sequence
  Description of Artificial Sequence: Synthetic oligonucleotide
  Target: ATXN1; (+) strand; PAM type: YTN; PAM sequence: CTC
gactgtgtttttttaacata

SEQ ID NO: 305679 - DNA, 20 bp, Artificial Sequence
  Description of Artificial Sequence: Synthetic oligonucleotide
  Target: ATXN1; (+) strand; PAM type: YTN; PAM sequence: CTG
tgtttttttaacataagact

SEQ ID NO: 305680 - DNA, 20 bp, Artificial Sequence
  Description of Artificial Sequence: Synthetic oligonucleotide
  Target: ATXN1; (+) strand; PAM type: YTN; PAM sequence: TTT
ttttaacataagactaaagc

SEQ ID NO: 305681 - DNA, 20 bp, Artificial Sequence
  Description of Artificial Sequence: Synthetic oligonucleotide
  Target: ATXN1; (+) strand; PAM type: YTN; PAM sequence: TTT
tttaacataagactaaagca

SEQ ID NO: 305682 - DNA, 20 bp, Artificial Sequence
  Description of Artificial Sequence: Synthetic oligonucleotide
  Target: ATXN1; (+) strand; PAM type: YTN; PAM sequence: TTT
ttaacataagactaaagcat

SEQ ID NO: 305683 - DNA, 20 bp, Artificial Sequence
  Description of Artificial Sequence: Synthetic oligonucleotide
  Target: ATXN1; (+) strand; PAM type: YTN; PAM sequence: TTT
taacataagactaaagcatg

SEQ ID NO: 305684 - DNA, 20 bp, Artificial Sequence
  Description of Artificial Sequence: Synthetic oligonucleotide
  Target: ATXN1; (+) strand; PAM type: YTN; PAM sequence: TTT
aacataagactaaagcatgt

SEQ ID NO: 305685 - DNA, 20 bp, Artificial Sequence
  Description of Artificial Sequence: Synthetic oligonucleotide
  Target: ATXN1; (+) strand; PAM type: YTN; PAM sequence: TTA
acataagactaaagcatgtt

SEQ ID NO: 305686 - DNA, 20 bp, Artificial Sequence
  Description of Artificial Sequence: Synthetic oligonucleotide
  Target: ATXN1; (+) strand; PAM type: YTN; PAM sequence: CTA
aagcatgttgattcttacac

SEQ ID NO: 305687 - DNA, 20 bp, Artificial Sequence
  Description of Artificial Sequence: Synthetic oligonucleotide
  Target: ATXN1; (+) strand; PAM type: YTN; PAM sequence: TTG
attcttacacaaatcataaa

SEQ ID NO: 305688 - DNA, 20 bp, Artificial Sequence
  Description of Artificial Sequence: Synthetic oligonucleotide
  Target: ATXN1; (+) strand; PAM type: YTN; PAM sequence: TTC
ttacacaaatcataaaagag

SEQ ID NO: 305689 - DNA, 20 bp, Artificial Sequence
  Description of Artificial Sequence: Synthetic oligonucleotide
  Target: ATXN1; (+) strand; PAM type: YTN; PAM sequence: CTT
acacaaatcataaaagagac

SEQ ID NO: 305690 - DNA, 20 bp, Artificial Sequence
  Description of Artificial Sequence: Synthetic oligonucleotide
  Target: ATXN1; (+) strand; PAM type: YTN; PAM sequence: TTA
cacaaatcataaaagagact

SEQ ID NO: 305691 - DNA, 20 bp, Artificial Sequence
  Description of Artificial Sequence: Synthetic oligonucleotide
  Target: ATXN1; (+) strand; PAM type: YTN; PAM sequence: CTA
tgaggaaagttcaaagtaac

SEQ ID NO: 305692 - DNA, 20 bp, Artificial Sequence
  Description of Artificial Sequence: Synthetic oligonucleotide
  Target: ATXN1; (+) strand; PAM type: YTN; PAM sequence: TTC
aaagtaacctcaagcatgat

SEQ ID NO: 305693 - DNA, 20 bp, Artificial Sequence
  Description of Artificial Sequence: Synthetic oligonucleotide
  Target: ATXN1; (+) strand; PAM type: YTN; PAM sequence: CTC
aagcatgatgacttcacgtt

SEQ ID NO: 305694 - DNA, 20 bp, Artificial Sequence
  Description of Artificial Sequence: Synthetic oligonucleotide
  Target: ATXN1; (+) strand; PAM type: YTN; PAM sequence: CTT
cacgttcaaaagatctttct

SEQ ID NO: 305695 - DNA, 20 bp, Artificial Sequence
  Description of Artificial Sequence: Synthetic oligonucleotide
  Target: ATXN1; (+) strand; PAM type: YTN; PAM sequence: TTC
acgttcaaaagatctttctc

SEQ ID NO: 305696 - DNA, 20 bp, Artificial Sequence
  Description of Artificial Sequence: Synthetic oligonucleotide
  Target: ATXN1; (+) strand; PAM type: YTN; PAM sequence: TTC
aaaagatctttctcatgtta

SEQ ID NO: 305697 - DNA, 20 bp, Artificial Sequence
  Description of Artificial Sequence: Synthetic oligonucleotide
  Target: ATXN1; (+) strand; PAM type: YTN; PAM sequence: CTT
tctcatgttaataacattta

SEQ ID NO: 305698 - DNA, 20 bp, Artificial Sequence
  Description of Artificial Sequence: Synthetic oligonucleotide
  Target: ATXN1; (+) strand; PAM type: YTN; PAM sequence: TTT
ctcatgttaataacatttaa

SEQ ID NO: 305699 - DNA, 20 bp, Artificial Sequence
  Description of Artificial Sequence: Synthetic oligonucleotide
  Target: ATXN1; (+) strand; PAM type: YTN; PAM sequence: TTC
tcatgttaataacatttaaa

SEQ ID NO: 305700 - DNA, 20 bp, Artificial Sequence
  Description of Artificial Sequence: Synthetic oligonucleotide
  Target: ATXN1; (+) strand; PAM type: YTN; PAM sequence: CTC
atgttaataacatttaaatc

SEQ ID NO: 305701 - DNA, 20 bp, Artificial Sequence
  Description of Artificial Sequence: Synthetic oligonucleotide
  Target: ATXN1; (+) strand; PAM type: YTN; PAM sequence: TTA
ataacatttaaatctctgcc

SEQ ID NO: 305702 - DNA, 20 bp, Artificial Sequence
  Description of Artificial Sequence: Synthetic oligonucleotide
  Target: ATXN1; (+) strand; PAM type: YTN; PAM sequence: TTT
aaatctctgcctgtgtgtga

SEQ ID NO: 305703 - DNA, 20 bp, Artificial Sequence
  Description of Artificial Sequence: Synthetic oligonucleotide
  Target: ATXN1; (+) strand; PAM type: YTN; PAM sequence: TTA
aatctctgcctgtgtgtgac

SEQ ID NO: 305704 - DNA, 20 bp, Artificial Sequence
  Description of Artificial Sequence: Synthetic oligonucleotide
  Target: ATXN1; (+) strand; PAM type: YTN; PAM sequence: CTC
tgcctgtgtgtgactcacat

SEQ ID NO: 305705 - DNA, 20 bp, Artificial Sequence
  Description of Artificial Sequence: Synthetic oligonucleotide
  Target: ATXN1; (+) strand; PAM type: YTN; PAM sequence: CTG
cctgtgtgtgactcacatgc

SEQ ID NO: 305706 - DNA, 20 bp, Artificial Sequence
  Description of Artificial Sequence: Synthetic oligonucleotide
  Target: ATXN1; (+) strand; PAM type: YTN; PAM sequence: CTG
tgtgtgactcacatgcctca

SEQ ID NO: 305707 - DNA, 20 bp, Artificial Sequence
  Description of Artificial Sequence: Synthetic oligonucleotide
  Target: ATXN1; (+) strand; PAM type: YTN; PAM sequence: CTC
acatgcctcagactggaagt

SEQ ID NO: 305708 - DNA, 20 bp, Artificial Sequence
  Description of Artificial Sequence: Synthetic oligonucleotide
  Target: ATXN1; (+) strand; PAM type: YTN; PAM sequence: CTC
agactggaagttcagcccaa

SEQ ID NO: 305709 - DNA, 20 bp, Artificial Sequence
  Description of Artificial Sequence: Synthetic oligonucleotide
  Target: ATXN1; (+) strand; PAM type: YTN; PAM sequence: CTG
gaagttcagcccaatcagct

SEQ ID NO: 305710 - DNA, 20 bp, Artificial Sequence
  Description of Artificial Sequence: Synthetic oligonucleotide
  Target: ATXN1; (+) strand; PAM type: YTN; PAM sequence: TTC
agcccaatcagctctcccaa

SEQ ID NO: 305711 - DNA, 20 bp, Artificial Sequence
  Description of Artificial Sequence: Synthetic oligonucleotide
  Target: ATXN1; (+) strand; PAM type: YTN; PAM sequence: CTC
tcccaactgattggtgaggg

SEQ ID NO: 305712 - DNA, 20 bp, Artificial Sequence
  Description of Artificial Sequence: Synthetic oligonucleotide
  Target: ATXN1; (+) strand; PAM type: YTN; PAM sequence: CTC
ccaactgattggtgagggaa

SEQ ID NO: 305713 - DNA, 20 bp, Artificial Sequence
  Description of Artificial Sequence: Synthetic oligonucleotide
  Target: ATXN1; (+) strand; PAM type: YTN; PAM sequence: CTG
attggtgagggaagtacata

SEQ ID NO: 305714 - DNA, 20 bp, Artificial Sequence
  Description of Artificial Sequence: Synthetic oligonucleotide
  Target: ATXN1; (+) strand; PAM type: YTN; PAM sequence: TTG
gtgagggaagtacatacttc

SEQ ID NO: 305715 - DNA, 20 bp, Artificial Sequence
  Description of Artificial Sequence: Synthetic oligonucleotide
  Target: ATXN1; (+) strand; PAM type: YTN; PAM sequence: CTT
cattgtcttaaaccccgagt

SEQ ID NO: 305716 - DNA, 20 bp, Artificial Sequence
  Description of Artificial Sequence: Synthetic oligonucleotide
  Target: ATXN1; (+) strand; PAM type: YTN; PAM sequence: TTC
attgtcttaaaccccgagtg

SEQ ID NO: 305717 - DNA, 20 bp, Artificial Sequence
  Description of Artificial Sequence: Synthetic oligonucleotide
  Target: ATXN1; (+) strand; PAM type: YTN; PAM sequence: TTG
tcttaaaccccgagtgactg

SEQ ID NO: 305718 - DNA, 20 bp, Artificial Sequence
  Description of Artificial Sequence: Synthetic oligonucleotide
  Target: ATXN1; (+) strand; PAM type: YTN; PAM sequence: CTT
aaaccccgagtgactggcat

SEQ ID NO: 305719 - DNA, 20 bp, Artificial Sequence
  Description of Artificial Sequence: Synthetic oligonucleotide
  Target: ATXN1; (+) strand; PAM type: YTN; PAM sequence: TTA
aaccccgagtgactggcatt

SEQ ID NO: 305720 - DNA, 20 bp, Artificial Sequence
  Description of Artificial Sequence: Synthetic oligonucleotide
  Target: ATXN1; (+) strand; PAM type: YTN; PAM sequence: CTG
gcattccctttaactgggca

SEQ ID NO: 305721 - DNA, 20 bp, Artificial Sequence
  Description of Artificial Sequence: Synthetic oligonucleotide
  Target: ATXN1; (+) strand; PAM type: YTN; PAM sequence: TTC
cctttaactgggcagtgtgt

SEQ ID NO: 305722 - DNA, 20 bp, Artificial Sequence
  Description of Artificial Sequence: Synthetic oligonucleotide
  Target: ATXN1; (+) strand; PAM type: YTN; PAM sequence: CTT
taactgggcagtgtgtctaa

SEQ ID NO: 305723 - DNA, 20 bp, Artificial Sequence
  Description of Artificial Sequence: Synthetic oligonucleotide
  Target: ATXN1; (+) strand; PAM type: YTN; PAM sequence: TTT
aactgggcagtgtgtctaaa

SEQ ID NO: 305724 - DNA, 20 bp, Artificial Sequence
  Description of Artificial Sequence: Synthetic oligonucleotide
  Target: ATXN1; (+) strand; PAM type: YTN; PAM sequence: TTA
actgggcagtgtgtctaaat

SEQ ID NO: 305725 - DNA, 20 bp, Artificial Sequence
  Description of Artificial Sequence: Synthetic oligonucleotide
  Target: ATXN1; (+) strand; PAM type: YTN; PAM sequence: CTG
ggcagtgtgtctaaatatgg

SEQ ID NO: 305726 - DNA, 20 bp, Artificial Sequence
  Description of Artificial Sequence: Synthetic oligonucleotide
  Target: ATXN1; (+) strand; PAM type: YTN; PAM sequence: CTA
aatatggaaaaacttcatga

SEQ ID NO: 305727 - DNA, 20 bp, Artificial Sequence
  Description of Artificial Sequence: Synthetic oligonucleotide
  Target: ATXN1; (+) strand; PAM type: YTN; PAM sequence: CTT
catgagaaactgaaacaggc

SEQ ID NO: 305728 - DNA, 20 bp, Artificial Sequence
  Description of Artificial Sequence: Synthetic oligonucleotide
  Target: ATXN1; (+) strand; PAM type: YTN; PAM sequence: TTC
atgagaaactgaaacaggca

SEQ ID NO: 305729 - DNA, 20 bp, Artificial Sequence
  Description of Artificial Sequence: Synthetic oligonucleotide
  Target: ATXN1; (+) strand; PAM type: YTN; PAM sequence: CTG
aaacaggcaaagaggaaaaa

SEQ ID NO: 305730 - DNA, 20 bp, Artificial Sequence
  Description of Artificial Sequence: Synthetic oligonucleotide
  Target: ATXN1; (+) strand; PAM type: YTN; PAM sequence: TTA
ctggcaccagtccttcagta

SEQ ID NO: 305731 - DNA, 20 bp, Artificial Sequence
  Description of Artificial Sequence: Synthetic oligonucleotide
  Target: ATXN1; (+) strand; PAM type: YTN; PAM sequence: CTG
gcaccagtccttcagtatga

SEQ ID NO: 305732 - DNA, 20 bp, Artificial Sequence
  Description of Artificial Sequence: Synthetic oligonucleotide
  Target: ATXN1; (+) strand; PAM type: YTN; PAM sequence: CTT
cagtatgaatcgagagaaaa

SEQ ID NO: 305733 - DNA, 20 bp, Artificial Sequence
  Description of Artificial Sequence: Synthetic oligonucleotide
  Target: ATXN1; (+) strand; PAM type: YTN; PAM sequence: TTC
agtatgaatcgagagaaaat

SEQ ID NO: 305734 - DNA, 20 bp, Artificial Sequence
  Description of Artificial Sequence: Synthetic oligonucleotide
  Target: ATXN1; (+) strand; PAM type: YTN; PAM sequence: TTC
atgaagtctccaaaagaatt

SEQ ID NO: 305735 - DNA, 20 bp, Artificial Sequence
  Description of Artificial Sequence: Synthetic oligonucleotide
  Target: ATXN1; (+) strand; PAM type: YTN; PAM sequence: CTC
caaaagaattttttaggtgt

SEQ ID NO: 305736 - DNA, 20 bp, Artificial Sequence
  Description of Artificial Sequence: Synthetic oligonucleotide
  Target: ATXN1; (+) strand; PAM type: YTN; PAM sequence: TTT
tttaggtgtctttttgatga

SEQ ID NO: 305737 - DNA, 20 bp, Artificial Sequence
  Description of Artificial Sequence: Synthetic oligonucleotide
  Target: ATXN1; (+) strand; PAM type: YTN; PAM sequence: TTT
ttaggtgtctttttgatgag

SEQ ID NO: 305738 - DNA, 20 bp, Artificial Sequence
  Description of Artificial Sequence: Synthetic oligonucleotide
  Target: ATXN1; (+) strand; PAM type: YTN; PAM sequence: TTT
taggtgtctttttgatgagc

SEQ ID NO: 305739 - DNA, 20 bp, Artificial Sequence
  Description of Artificial Sequence: Synthetic oligonucleotide
  Target: ATXN1; (+) strand; PAM type: YTN; PAM sequence: TTT
aggtgtctttttgatgagca

SEQ ID NO: 305740 - DNA, 20 bp, Artificial Sequence
  Description of Artificial Sequence: Synthetic oligonucleotide
  Target: ATXN1; (+) strand; PAM type: YTN; PAM sequence: TTA
ggtgtctttttgatgagcag

SEQ ID NO: 305741 - DNA, 20 bp, Artificial Sequence
  Description of Artificial Sequence: Synthetic oligonucleotide
  Target: ATXN1; (+) strand; PAM type: YTN; PAM sequence: CTT
tttgatgagcaggaattcca

SEQ ID NO: 305742 - DNA, 20 bp, Artificial Sequence
  Description of Artificial Sequence: Synthetic oligonucleotide
  Target: ATXN1; (+) strand; PAM type: YTN; PAM sequence: TTT
ttgatgagcaggaattccag

SEQ ID NO: 305743 - DNA, 20 bp, Artificial Sequence
  Description of Artificial Sequence: Synthetic oligonucleotide
  Target: ATXN1; (+) strand; PAM type: YTN; PAM sequence: TTT
tgatgagcaggaattccagt

SEQ ID NO: 305744 - DNA, 20 bp, Artificial Sequence
  Description of Artificial Sequence: Synthetic oligonucleotide
  Target: ATXN1; (+) strand; PAM type: YTN; PAM sequence: TTT
gatgagcaggaattccagtg

SEQ ID NO: 305745 - DNA, 20 bp, Artificial Sequence
  Description of Artificial Sequence: Synthetic oligonucleotide
  Target: ATXN1; (+) strand; PAM type: YTN; PAM sequence: TTG
atgagcaggaattccagtgc

SEQ ID NO: 305746 - DNA, 20 bp, Artificial Sequence
  Description of Artificial Sequence: Synthetic oligonucleotide
  Target: ATXN1; (+) strand; PAM type: YTN; PAM sequence: TTC
cagtgcctagggctttcagt

SEQ ID NO: 305747 - DNA, 20 bp, Artificial Sequence
  Description of Artificial Sequence: Synthetic oligonucleotide
  Target: ATXN1; (+) strand; PAM type: YTN; PAM sequence: CTA
gggctttcagttctttgtgc

SEQ ID NO: 305748 - DNA, 20 bp, Artificial Sequence
  Description of Artificial Sequence: Synthetic oligonucleotide
  Target: ATXN1; (+) strand; PAM type: YTN; PAM sequence: CTT
tcagttctttgtgcatcaaa

SEQ ID NO: 305749 - DNA, 20 bp, Artificial Sequence
  Description of Artificial Sequence: Synthetic oligonucleotide
  Target: ATXN1; (+) strand; PAM type: YTN; PAM sequence: TTT
cagttctttgtgcatcaaag

SEQ ID NO: 305750 - DNA, 20 bp, Artificial Sequence
  Description of Artificial Sequence: Synthetic oligonucleotide
  Target: ATXN1; (+) strand; PAM type: YTN; PAM sequence: TTC
agttctttgtgcatcaaagt

SEQ ID NO: 305751 - DNA, 20 bp, Artificial Sequence
  Description of Artificial Sequence: Synthetic oligonucleotide
  Target: ATXN1; (+) strand; PAM type: YTN; PAM sequence: TTC
tttgtgcatcaaagttttct

SEQ ID NO: 305752 - DNA, 20 bp, Artificial Sequence
  Description of Artificial Sequence: Synthetic oligonucleotide
  Target: ATXN1; (+) strand; PAM type: YTN; PAM sequence: CTT
tgtgcatcaaagttttcttc

SEQ ID NO: 305753 - DNA, 20 bp, Artificial Sequence
  Description of Artificial Sequence: Synthetic oligonucleotide
  Target: ATXN1; (+) strand; PAM type: YTN; PAM sequence: TTT
gtgcatcaaagttttcttct

SEQ ID NO: 305754 - DNA, 20 bp, Artificial Sequence
  Description of Artificial Sequence: Synthetic oligonucleotide
  Target: ATXN1; (+) strand; PAM type: YTN; PAM sequence: TTG
tgcatcaaagttttcttcta

SEQ ID NO: 305755 - DNA, 20 bp, Artificial Sequence
  Description of Artificial Sequence: Synthetic oligonucleotide
  Target: ATXN1; (+) strand; PAM type: YTN; PAM sequence: TTT
tcttctaagcatgtatggtc

SEQ ID NO: 305756 - DNA, 20 bp, Artificial Sequence
  Description of Artificial Sequence: Synthetic oligonucleotide
  Target: ATXN1; (+) strand; PAM type: YTN; PAM sequence: TTT
cttctaagcatgtatggtca

SEQ ID NO: 305757 - DNA, 20 bp, Artificial Sequence
  Description of Artificial Sequence: Synthetic oligonucleotide
  Target: ATXN1; (+) strand; PAM type: YTN; PAM sequence: TTC
ttctaagcatgtatggtcat

SEQ ID NO: 305758 - DNA, 20 bp, Artificial Sequence
  Description of Artificial Sequence: Synthetic oligonucleotide
  Target: ATXN1; (+) strand; PAM type: YTN; PAM sequence: CTT
ctaagcatgtatggtcatgg

SEQ ID NO: 305759 - DNA, 20 bp, Artificial Sequence
  Description of Artificial Sequence: Synthetic oligonucleotide
  Target: ATXN1; (+) strand; PAM type: YTN; PAM sequence: TTC
taagcatgtatggtcatgga

SEQ ID NO: 305760 - DNA, 20 bp, Artificial Sequence
  Description of Artificial Sequence: Synthetic oligonucleotide
  Target: ATXN1; (+) strand; PAM type: YTN; PAM sequence: CTA
agcatgtatggtcatggaag

SEQ ID NO: 305761 - DNA, 20 bp, Artificial Sequence
  Description of Artificial Sequence: Synthetic oligonucleotide
  Target: ATXN1; (+) strand; PAM type: YTN; PAM sequence: CTG
gagtatctttcatgacaatg

SEQ ID NO: 305762 - DNA, 20 bp, Artificial Sequence
  Description of Artificial Sequence: Synthetic oligonucleotide
  Target: ATXN1; (+) strand; PAM type: YTN; PAM sequence: CTT
tcatgacaatggcctctaat

SEQ ID NO: 305763 - DNA, 20 bp, Artificial Sequence
  Description of Artificial Sequence: Synthetic oligonucleotide
  Target: ATXN1; (+) strand; PAM type: YTN; PAM sequence: TTT
catgacaatggcctctaatc

SEQ ID NO: 305764 - DNA, 20 bp, Artificial Sequence
  Description of Artificial Sequence: Synthetic oligonucleotide
  Target: ATXN1; (+) strand; PAM type: YTN; PAM sequence: TTC
atgacaatggcctctaatca

SEQ ID NO: 305765 - DNA, 20 bp, Artificial Sequence
  Description of Artificial Sequence: Synthetic oligonucleotide
  Target: ATXN1; (+) strand; PAM type: YTN; PAM sequence: CTC
taatcaaacccagtgttcac

SEQ ID NO: 305766 - DNA, 20 bp, Artificial Sequence
  Description of Artificial Sequence: Synthetic oligonucleotide
  Target: ATXN1; (+) strand; PAM type: YTN; PAM sequence: CTA
atcaaacccagtgttcaccc

SEQ ID NO: 305767 - DNA, 20 bp, Artificial Sequence
  Description of Artificial Sequence: Synthetic oligonucleotide
  Target: ATXN1; (+) strand; PAM type: YTN; PAM sequence: TTC
acccctgagagacgacctgt

SEQ ID NO: 305768 - DNA, 20 bp, Artificial Sequence
  Description of Artificial Sequence: Synthetic oligonucleotide
  Target: ATXN1; (+) strand; PAM type: YTN; PAM sequence: CTG
agagacgacctgtgcacttc

SEQ ID NO: 305769 - DNA, 20 bp, Artificial Sequence
  Description of Artificial Sequence: Synthetic oligonucleotide
  Target: ATXN1; (+) strand; PAM type: YTN; PAM sequence: CTG
tgcacttcactccatccatc

SEQ ID NO: 305770 - DNA, 20 bp, Artificial Sequence
  Description of Artificial Sequence: Synthetic oligonucleotide
  Target: ATXN1; (+) strand; PAM type: YTN; PAM sequence: CTT
cactccatccatcacaggca

SEQ ID NO: 305771 - DNA, 20 bp, Artificial Sequence
  Description of Artificial Sequence: Synthetic oligonucleotide
  Target: ATXN1; (+) strand; PAM type: YTN; PAM sequence: TTC
actccatccatcacaggcaa

SEQ ID NO: 305772 - DNA, 20 bp, Artificial Sequence
  Description of Artificial Sequence: Synthetic oligonucleotide
  Target: ATXN1; (+) strand; PAM type: YTN; PAM sequence: CTC
catccatcacaggcaactaa

SEQ ID NO: 305773 - DNA, 20 bp, Artificial Sequence
  Description of Artificial Sequence: Synthetic oligonucleotide
  Target: ATXN1; (+) strand; PAM type: YTN; PAM sequence: CTA
aatatacaaccagggcaagc

SEQ ID NO: 305774 - DNA, 20 bp, Artificial Sequence
  Description of Artificial Sequence: Synthetic oligonucleotide
  Target: ATXN1; (+) strand; PAM type: YTN; PAM sequence: CTG
gagctggctatttacaacct

SEQ ID NO: 305775 - DNA, 20 bp, Artificial Sequence
  Description of Artificial Sequence: Synthetic oligonucleotide
  Target: ATXN1; (+) strand; PAM type: YTN; PAM sequence: CTG
gctatttacaaccttgctct

SEQ ID NO: 305776 - DNA, 20 bp, Artificial Sequence
  Description of Artificial Sequence: Synthetic oligonucleotide
  Target: ATXN1; (+) strand; PAM type: YTN; PAM sequence: CTA
tttacaaccttgctctgctc

SEQ ID NO: 305777 - DNA, 20 bp, Artificial Sequence
  Description of Artificial Sequence: Synthetic oligonucleotide
  Target: ATXN1; (+) strand; PAM type: YTN; PAM sequence: TTT
acaaccttgctctgctctaa

SEQ ID NO: 305778 - DNA, 20 bp, Artificial Sequence
  Description of Artificial Sequence: Synthetic oligonucleotide
  Target: ATXN1; (+) strand; PAM type: YTN; PAM sequence: TTA
caaccttgctctgctctaaa

SEQ ID NO: 305779 - DNA, 20 bp, Artificial Sequence
  Description of Artificial Sequence: Synthetic oligonucleotide
  Target: ATXN1; (+) strand; PAM type: YTN; PAM sequence: CTT
gctctgctctaaaactttct

SEQ ID NO: 305780 - DNA, 20 bp, Artificial Sequence
  Description of Artificial Sequence: Synthetic oligonucleotide
  Target: ATXN1; (+) strand; PAM type: YTN; PAM sequence: TTG
ctctgctctaaaactttcta

SEQ ID NO: 305781 - DNA, 20 bp, Artificial Sequence
  Description of Artificial Sequence: Synthetic oligonucleotide
  Target: ATXN1; (+) strand; PAM type: YTN; PAM sequence: CTC
tgctctaaaactttctacgg

SEQ ID NO: 305782 - DNA, 20 bp, Artificial Sequence
  Description of Artificial Sequence: Synthetic oligonucleotide
  Target: ATXN1; (+) strand; PAM type: YTN; PAM sequence: CTG
ctctaaaactttctacggga

SEQ ID NO: 305783 - DNA, 20 bp, Artificial Sequence
  Description of Artificial Sequence: Synthetic oligonucleotide
  Target: ATXN1; (+) strand; PAM type: YTN; PAM sequence: CTC
taaaactttctacgggacaa

SEQ ID NO: 305784 - DNA, 20 bp, Artificial Sequence
  Description of Artificial Sequence: Synthetic oligonucleotide
  Target: ATXN1; (+) strand; PAM type: YTN; PAM sequence: CTA
aaactttctacgggacaacc

SEQ ID NO: 305785 - DNA, 20 bp, Artificial Sequence
  Description of Artificial Sequence: Synthetic oligonucleotide
  Target: ATXN1; (+) strand; PAM type: YTN; PAM sequence: CTT
tctacgggacaaccattcag

SEQ ID NO: 305786 - DNA, 20 bp, Artificial Sequence
  Description of Artificial Sequence: Synthetic oligonucleotide
  Target: ATXN1; (+) strand; PAM type: YTN; PAM sequence: TTT
ctacgggacaaccattcaga

SEQ ID NO: 305787 - DNA, 20 bp, Artificial Sequence
  Description of Artificial Sequence: Synthetic oligonucleotide
  Target: ATXN1; (+) strand; PAM type: YTN; PAM sequence: TTC
tacgggacaaccattcagac

SEQ ID NO: 305788 - DNA, 20 bp, Artificial Sequence
  Description of Artificial Sequence: Synthetic oligonucleotide
  Target: ATXN1; (+) strand; PAM type: YTN; PAM sequence: CTA
cgggacaaccattcagaccc

SEQ ID NO: 305789 - DNA, 20 bp, Artificial Sequence
  Description of Artificial Sequence: Synthetic oligonucleotide
  Target: ATXN1; (+) strand; PAM type: YTN; PAM sequence: TTC
agacccgagttctatgtaca

SEQ ID NO: 305790 - DNA, 20 bp, Artificial Sequence
  Description of Artificial Sequence: Synthetic oligonucleotide
  Target: ATXN1; (+) strand; PAM type: YTN; PAM sequence: TTC
tatgtacaataggtttcagc

SEQ ID NO: 305791 - DNA, 20 bp, Artificial Sequence
  Description of Artificial Sequence: Synthetic oligonucleotide
  Target: ATXN1; (+) strand; PAM type: YTN; PAM sequence: CTA
tgtacaataggtttcagcct

SEQ ID NO: 305792 - DNA, 20 bp, Artificial Sequence
  Description of Artificial Sequence: Synthetic oligonucleotide
  Target: ATXN1; (+) strand; PAM type: YTN; PAM sequence: TTT
cagccttagcaaattagata

SEQ ID NO: 305793 - DNA, 20 bp, Artificial Sequence
  Description of Artificial Sequence: Synthetic oligonucleotide
  Target: ATXN1; (+) strand; PAM type: YTN; PAM sequence: TTC
agccttagcaaattagatag

SEQ ID NO: 305794 - DNA, 20 bp, Artificial Sequence
  Description of Artificial Sequence: Synthetic oligonucleotide
  Target: ATXN1; (+) strand; PAM type: YTN; PAM sequence: CTT
agcaaattagatagatgcac

SEQ ID NO: 305795 - DNA, 20 bp, Artificial Sequence
  Description of Artificial Sequence: Synthetic oligonucleotide
  Target: ATXN1; (+) strand; PAM type: YTN; PAM sequence: TTA
gcaaattagatagatgcact

SEQ ID NO: 305796 - DNA, 20 bp, Artificial Sequence
  Description of Artificial Sequence: Synthetic oligonucleotide
  Target: ATXN1; (+) strand; PAM type: YTN; PAM sequence: TTA
gatagatgcactgacttact

SEQ ID NO: 305797 - DNA, 20 bp, Artificial Sequence
  Description of Artificial Sequence: Synthetic oligonucleotide
  Target: ATXN1; (+) strand; PAM type: YTN; PAM sequence: CTG
acttacttgctaaagaacct

SEQ ID NO: 305798 - DNA, 20 bp, Artificial Sequence
  Description of Artificial Sequence: Synthetic oligonucleotide
  Target: ATXN1; (+) strand; PAM type: YTN; PAM sequence: CTT
acttgctaaagaacctgagg

SEQ ID NO: 305799 - DNA, 20 bp, Artificial Sequence
  Description of Artificial Sequence: Synthetic oligonucleotide
  Target: ATXN1; (+) strand; PAM type: YTN; PAM sequence: TTA
cttgctaaagaacctgagga

SEQ ID NO: 305800 - DNA, 20 bp, Artificial Sequence
  Description of Artificial Sequence: Synthetic oligonucleotide
  Target: ATXN1; (+) strand; PAM type: YTN; PAM sequence: CTT
gctaaagaacctgaggaatg

SEQ ID NO: 305801 - DNA, 20 bp, Artificial Sequence
  Description of Artificial Sequence: Synthetic oligonucleotide
  Target: ATXN1; (+) strand; PAM type: YTN; PAM sequence: TTG
ctaaagaacctgaggaatga

SEQ ID NO: 305802 - DNA, 20 bp, Artificial Sequence
  Description of Artificial Sequence: Synthetic oligonucleotide
  Target: ATXN1; (+) strand; PAM type: YTN; PAM sequence: CTA
aagaacctgaggaatgacgc

SEQ ID NO: 305803 - DNA, 20 bp, Artificial Sequence
  Description of Artificial Sequence: Synthetic oligonucleotide
  Target: ATXN1; (+) strand; PAM type: YTN; PAM sequence: CTG
aggaatgacgccttaatttt

SEQ ID NO: 305804 - DNA, 20 bp, Artificial Sequence
  Description of Artificial Sequence: Synthetic oligonucleotide
  Target: ATXN1; (+) strand; PAM type: YTN; PAM sequence: CTT
aatttttattataggatata

SEQ ID NO: 305805 - DNA, 20 bp, Artificial Sequence
  Description of Artificial Sequence: Synthetic oligonucleotide
  Target: ATXN1; (+) strand; PAM type: YTN; PAM sequence: TTA
atttttattataggatatat

SEQ ID NO: 305806 - DNA, 20 bp, Artificial Sequence
  Description of Artificial Sequence: Synthetic oligonucleotide
  Target: ATXN1; (+) strand; PAM type: YTN; PAM sequence: TTT
ttattataggatatattaat

SEQ ID NO: 305807 - DNA, 20 bp, Artificial Sequence
  Description of Artificial Sequence: Synthetic oligonucleotide
  Target: ATXN1; (+) strand; PAM type: YTN; PAM sequence: TTT
tattataggatatattaata

SEQ ID NO: 305808 - DNA, 20 bp, Artificial Sequence
  Description of Artificial Sequence: Synthetic oligonucleotide
  Target: ATXN1; (+) strand; PAM type: YTN; PAM sequence: TTT
attataggatatattaatag

SEQ ID NO: 305809 - DNA, 20 bp, Artificial Sequence
  Description of Artificial Sequence: Synthetic oligonucleotide
  Target: ATXN1; (+) strand; PAM type: YTN; PAM sequence: TTA
ttataggatatattaatagt

SEQ ID NO: 305810 - DNA, 20 bp, Artificial Sequence
  Description of Artificial Sequence: Synthetic oligonucleotide
  Target: ATXN1; (+) strand; PAM type: YTN; PAM sequence: TTA
taggatatattaatagtgtt

SEQ ID NO: 305811 - DNA, 20 bp, Artificial Sequence
  Description of Artificial Sequence: Synthetic oligonucleotide
  Target: ATXN1; (+) strand; PAM type: YTN; PAM sequence: TTA
atagtgtttggtaaagctga

SEQ ID NO: 305812 - DNA, 20 bp, Artificial Sequence
  Description of Artificial Sequence: Synthetic oligonucleotide
  Target: ATXN1; (+) strand; PAM type: YTN; PAM sequence: TTT
ggtaaagctgatatagagtc

SEQ ID NO: 305813 - DNA, 20 bp, Artificial Sequence
  Description of Artificial Sequence: Synthetic oligonucleotide
  Target: ATXN1; (+) strand; PAM type: YTN; PAM sequence: TTG
gtaaagctgatatagagtca

SEQ ID NO: 305814 - DNA, 20 bp, Artificial Sequence
  Description of Artificial Sequence: Synthetic oligonucleotide
  Target: ATXN1; (+) strand; PAM type: YTN; PAM sequence: CTG
atatagagtcaggtttgatt

SEQ ID NO: 305815 - DNA, 20 bp, Artificial Sequence
  Description of Artificial Sequence: Synthetic oligonucleotide
  Target: ATXN1; (+) strand; PAM type: YTN; PAM sequence: TTT
gattgctgatatagaatcag

SEQ ID NO: 305816 - DNA, 20 bp, Artificial Sequence
  Description of Artificial Sequence: Synthetic oligonucleotide
  Target: ATXN1; (+) strand; PAM type: YTN; PAM sequence: TTG
attgctgatatagaatcagg

SEQ ID NO: 305817 - DNA, 20 bp, Artificial Sequence
  Description of Artificial Sequence: Synthetic oligonucleotide
  Target: ATXN1; (+) strand; PAM type: YTN; PAM sequence: TTG
ctgatatagaatcaggtttg

SEQ ID NO: 305818 - DNA, 20 bp, Artificial Sequence
  Description of Artificial Sequence: Synthetic oligonucleotide
  Target: ATXN1; (+) strand; PAM type: YTN; PAM sequence: CTG
atatagaatcaggtttgatt

SEQ ID NO: 305819 - DNA, 20 bp, Artificial Sequence
  Description of Artificial Sequence: Synthetic oligonucleotide
  Target: ATXN1; (+) strand; PAM type: YTN; PAM sequence: TTT
gattactgtcatgactcaga

SEQ ID NO: 305820 - DNA, 20 bp, Artificial Sequence
  Description of Artificial Sequence: Synthetic oligonucleotide
  Target: ATXN1; (+) strand; PAM type: YTN; PAM sequence: TTG
attactgtcatgactcagag

SEQ ID NO: 305821 - DNA, 20 bp, Artificial Sequence
  Description of Artificial Sequence: Synthetic oligonucleotide
  Target: ATXN1; (+) strand; PAM type: YTN; PAM sequence: TTA
ctgtcatgactcagaggctt

SEQ ID NO: 305822 - DNA, 20 bp, Artificial Sequence
  Description of Artificial Sequence: Synthetic oligonucleotide
  Target: ATXN1; (+) strand; PAM type: YTN; PAM sequence: CTG
tcatgactcagaggctttat

SEQ ID NO: 305823 - DNA, 20 bp, Artificial Sequence
  Description of Artificial Sequence: Synthetic oligonucleotide
  Target: ATXN1; (+) strand; PAM type: YTN; PAM sequence: CTC
agaggctttataatttgaca

SEQ ID NO: 305824 - DNA, 20 bp, Artificial Sequence
  Description of Artificial Sequence: Synthetic oligonucleotide
  Target: ATXN1; (+) strand; PAM type: YTN; PAM sequence: CTT
tataatttgacatattttat

SEQ ID NO: 305825 - DNA, 20 bp, Artificial Sequence
  Description of Artificial Sequence: Synthetic oligonucleotide
  Target: ATXN1; (+) strand; PAM type: YTN; PAM sequence: TTT
ataatttgacatattttatc

SEQ ID NO: 305826 - DNA, 20 bp, Artificial Sequence
  Description of Artificial Sequence: Synthetic oligonucleotide
  Target: ATXN1; (+) strand; PAM type: YTN; PAM sequence: TTA
taatttgacatattttatct

SEQ ID NO: 305827 - DNA, 20 bp, Artificial Sequence
  Description of Artificial Sequence: Synthetic oligonucleotide
  Target: ATXN1; (+) strand; PAM type: YTN; PAM sequence: TTT
gacatattttatctggataa

SEQ ID NO: 305828 - DNA, 20 bp, Artificial Sequence
  Description of Artificial Sequence: Synthetic oligonucleotide
  Target: ATXN1; (+) strand; PAM type: YTN; PAM sequence: TTG
acatattttatctggataac

SEQ ID NO: 305829 - DNA, 20 bp, Artificial Sequence
  Description of Artificial Sequence: Synthetic oligonucleotide
  Target: ATXN1; (+) strand; PAM type: YTN; PAM sequence: TTT
tatctggataactttagatt

SEQ ID NO: 305830 - DNA, 20 bp, Artificial Sequence
  Description of Artificial Sequence: Synthetic oligonucleotide
  Target: ATXN1; (+) strand; PAM type: YTN; PAM sequence: TTT
atctggataactttagattt

SEQ ID NO: 305831 - DNA, 20 bp, Artificial Sequence
  Description of Artificial Sequence: Synthetic oligonucleotide
  Target: ATXN1; (+) strand; PAM type: YTN; PAM sequence: TTA
tctggataactttagatttt

SEQ ID NO: 305832 - DNA, 20 bp, Artificial Sequence
  Description of Artificial Sequence: Synthetic oligonucleotide
  Target: ATXN1; (+) strand; PAM type: YTN; PAM sequence: CTG
gataactttagatttttcct

SEQ ID NO: 305833 - DNA, 20 bp, Artificial Sequence
  Description of Artificial Sequence: Synthetic oligonucleotide
  Target: ATXN1; (+) strand; PAM type: YTN; PAM sequence: CTT
tagatttttcctgttatttt

SEQ ID NO: 305834 - DNA, 20 bp, Artificial Sequence
  Description of Artificial Sequence: Synthetic oligonucleotide
  Target: ATXN1; (+) strand; PAM type: YTN; PAM sequence: TTT
agatttttcctgttattttg

SEQ ID NO: 305835 - DNA, 20 bp, Artificial Sequence
  Description of Artificial Sequence: Synthetic oligonucleotide
  Target: ATXN1; (+) strand; PAM type: YTN; PAM sequence: TTA
gatttttcctgttattttgg

SEQ ID NO: 305836 - DNA, 20 bp, Artificial Sequence
  Description of Artificial Sequence: Synthetic oligonucleotide
  Target: ATXN1; (+) strand; PAM type: YTN; PAM sequence: TTT
ttcctgttattttggtactg

SEQ ID NO: 305837 - DNA, 20 bp, Artificial Sequence
  Description of Artificial Sequence: Synthetic oligonucleotide
  Target: ATXN1; (+) strand; PAM type: YTN; PAM sequence: TTT
tcctgttattttggtactgg

SEQ ID NO: 305838 - DNA, 20 bp, Artificial Sequence
  Description of Artificial Sequence: Synthetic oligonucleotide
  Target: ATXN1; (+) strand; PAM type: YTN; PAM sequence: TTT
cctgttattttggtactggg

SEQ ID NO: 305839 - DNA, 20 bp, Artificial Sequence
  Description of Artificial Sequence: Synthetic oligonucleotide
  Target: ATXN1; (+) strand; PAM type: YTN; PAM sequence: TTC
ctgttattttggtactgggt

SEQ ID NO: 305840 - DNA, 20 bp, Artificial Sequence
  Description of Artificial Sequence: Synthetic oligonucleotide
  Target: ATXN1; (+) strand; PAM type: YTN; PAM sequence: CTG
ttattttggtactgggttgc

SEQ ID NO: 305841 - DNA, 20 bp, Artificial Sequence
  Description of Artificial Sequence: Synthetic oligonucleotide
  Target: ATXN1; (+) strand; PAM type: YTN; PAM sequence: TTA
ttttggtactgggttgcagc

SEQ ID NO: 305842 - DNA, 20 bp, Artificial Sequence
  Description of Artificial Sequence: Synthetic oligonucleotide
  Target: ATXN1; (+) strand; PAM type: YTN; PAM sequence: TTT
tggtactgggttgcagcaca

SEQ ID NO: 305843 - DNA, 20 bp, Artificial Sequence
  Description of Artificial Sequence: Synthetic oligonucleotide
  Target: ATXN1; (+) strand; PAM type: YTN; PAM sequence: TTT
ggtactgggttgcagcacac

SEQ ID NO: 305844 - DNA, 20 bp, Artificial Sequence
  Description of Artificial Sequence: Synthetic oligonucleotide
  Target: ATXN1; (+) strand; PAM type: YTN; PAM sequence: TTG
gtactgggttgcagcacaca

SEQ ID NO: 305845 - DNA, 20 bp, Artificial Sequence
  Description of Artificial Sequence: Synthetic oligonucleotide
  Target: ATXN1; (+) strand; PAM type: YTN; PAM sequence: CTG
ggttgcagcacacaggtggc

SEQ ID NO: 305846 - DNA, 20 bp, Artificial Sequence
  Description of Artificial Sequence: Synthetic oligonucleotide
  Target: ATXN1; (+) strand; PAM type: YTN; PAM sequence: TTG
cagcacacaggtggcaccta

SEQ ID NO: 305847 - DNA, 20 bp, Artificial Sequence
  Description of Artificial Sequence: Synthetic oligonucleotide
  Target: ATXN1; (+) strand; PAM type: YTN; PAM sequence: CTA
gtcttagggctgtgaggatc

SEQ ID NO: 305848 - DNA, 20 bp, Artificial Sequence
  Description of Artificial Sequence: Synthetic oligonucleotide
  Target: ATXN1; (+) strand; PAM type: YTN; PAM sequence: CTT
agggctgtgaggatcccgcc

SEQ ID NO: 305849 - DNA, 20 bp, Artificial Sequence
  Description of Artificial Sequence: Synthetic oligonucleotide
  Target: ATXN1; (+) strand; PAM type: YTN; PAM sequence: TTA
gggctgtgaggatcccgcca

SEQ ID NO: 305850 - DNA, 20 bp, Artificial Sequence
  Description of Artificial Sequence: Synthetic oligonucleotide
  Target: ATXN1; (+) strand; PAM type: YTN; PAM sequence: CTG
tgaggatcccgccatggcct

SEQ ID NO: 305851 - DNA, 20 bp, Artificial Sequence
  Description of Artificial Sequence: Synthetic oligonucleotide
  Target: ATXN1; (+) strand; PAM type: YTN; PAM sequence: CTG
agctcagtcactattaccag

SEQ ID NO: 305852 - DNA, 20 bp, Artificial Sequence
  Description of Artificial Sequence: Synthetic oligonucleotide
  Target: ATXN1; (+) strand; PAM type: YTN; PAM sequence: CTC
agtcactattaccagcttca

SEQ ID NO: 305853 - DNA, 20 bp, Artificial Sequence
  Description of Artificial Sequence: Synthetic oligonucleotide
  Target: ATXN1; (+) strand; PAM type: YTN; PAM sequence: CTA
ttaccagcttcaccagagaa

SEQ ID NO: 305854 - DNA, 20 bp, Artificial Sequence
  Description of Artificial Sequence: Synthetic oligonucleotide
  Target: ATXN1; (+) strand; PAM type: YTN; PAM sequence: TTA
ccagcttcaccagagaaaga

SEQ ID NO: 305855 - DNA, 20 bp, Artificial Sequence
  Description of Artificial Sequence: Synthetic oligonucleotide
  Target: ATXN1; (+) strand; PAM type: YTN; PAM sequence: CTT
caccagagaaagacaggaag

SEQ ID NO: 305856 - DNA, 20 bp, Artificial Sequence
  Description of Artificial Sequence: Synthetic oligonucleotide
  Target: ATXN1; (+) strand; PAM type: YTN; PAM sequence: TTC
accagagaaagacaggaagt

SEQ ID NO: 305857 - DNA, 20 bp, Artificial Sequence
  Description of Artificial Sequence: Synthetic oligonucleotide
  Target: ATXN1; (+) strand; PAM type: YTN; PAM sequence: CTA
acatgagtttcccagagaaa

SEQ ID NO: 305858 - DNA, 20 bp, Artificial Sequence
  Description of Artificial Sequence: Synthetic oligonucleotide
  Target: ATXN1; (+) strand; PAM type: YTN; PAM sequence: TTT
cccagagaaacacaacttat

SEQ ID NO: 305859 - DNA, 20 bp, Artificial Sequence
  Description of Artificial Sequence: Synthetic oligonucleotide
  Target: ATXN1; (+) strand; PAM type: YTN; PAM sequence: TTC
ccagagaaacacaacttatt

SEQ ID NO: 305860 - DNA, 20 bp, Artificial Sequence
  Description of Artificial Sequence: Synthetic oligonucleotide
  Target: ATXN1; (+) strand; PAM type: YTN; PAM sequence: CTT
attttaatgtcaaacctgtt

SEQ ID NO: 305861 - DNA, 20 bp, Artificial Sequence
  Description of Artificial Sequence: Synthetic oligonucleotide
  Target: ATXN1; (+) strand; PAM type: YTN; PAM sequence: TTA
ttttaatgtcaaacctgtta

SEQ ID NO: 305862 - DNA, 20 bp, Artificial Sequence
  Description of Artificial Sequence: Synthetic oligonucleotide
  Target: ATXN1; (+) strand; PAM type: YTN; PAM sequence: TTT
taatgtcaaacctgttaaac

SEQ ID NO: 305863 - DNA, 20 bp, Artificial Sequence
  Description of Artificial Sequence: Synthetic oligonucleotide
  Target: ATXN1; (+) strand; PAM type: YTN; PAM sequence: TTT
aatgtcaaacctgttaaact

SEQ ID NO: 305864 - DNA, 20 bp, Artificial Sequence
  Description of Artificial Sequence: Synthetic oligonucleotide
  Target: ATXN1; (+) strand; PAM type: YTN; PAM sequence: TTA
atgtcaaacctgttaaacta

SEQ ID NO: 305865 - DNA, 20 bp, Artificial Sequence
  Description of Artificial Sequence: Synthetic oligonucleotide
  Target: ATXN1; (+) strand; PAM type: YTN; PAM sequence: CTG
ttaaactaaattatgatcca

SEQ ID NO: 305866 - DNA, 20 bp, Artificial Sequence
  Description of Artificial Sequence: Synthetic oligonucleotide
  Target: ATXN1; (+) strand; PAM type: YTN; PAM sequence: TTA
aactaaattatgatccattt

SEQ ID NO: 305867 - DNA, 20 bp, Artificial Sequence
  Description of Artificial Sequence: Synthetic oligonucleotide
  Target: ATXN1; (+) strand; PAM type: YTN; PAM sequence: CTA
aattatgatccatttgagag

SEQ ID NO: 305868 - DNA, 20 bp, Artificial Sequence
  Description of Artificial Sequence: Synthetic oligonucleotide
  Target: ATXN1; (+) strand; PAM type: YTN; PAM sequence: TTA
tgatccatttgagagaaggc

SEQ ID NO: 305869 - DNA, 20 bp, Artificial Sequence
  Description of Artificial Sequence: Synthetic oligonucleotide
  Target: ATXN1; (+) strand; PAM type: YTN; PAM sequence: TTT
gagagaaggcaggtcagatg

SEQ ID NO: 305870 - DNA, 20 bp, Artificial Sequence
  Description of Artificial Sequence: Synthetic oligonucleotide
  Target: ATXN1; (+) strand; PAM type: YTN; PAM sequence: TTG
agagaaggcaggtcagatga

SEQ ID NO: 305871 - DNA, 20 bp, Artificial Sequence
  Description of Artificial Sequence: Synthetic oligonucleotide
  Target: ATXN1; (+) strand; PAM type: YTN; PAM sequence: CTA
aaactaaccgtttattaagt

SEQ ID NO: 305872 - DNA, 20 bp, Artificial Sequence
  Description of Artificial Sequence: Synthetic oligonucleotide
  Target: ATXN1; (+) strand; PAM type: YTN; PAM sequence: CTA
accgtttattaagttttgaa

SEQ ID NO: 305873 - DNA, 20 bp, Artificial Sequence
  Description of Artificial Sequence: Synthetic oligonucleotide
  Target: ATXN1; (+) strand; PAM type: YTN; PAM sequence: TTT
attaagttttgaagaatgga

SEQ ID NO: 305874 - DNA, 20 bp, Artificial Sequence
  Description of Artificial Sequence: Synthetic oligonucleotide
  Target: ATXN1; (+) strand; PAM type: YTN; PAM sequence: TTA
ttaagttttgaagaatggaa

SEQ ID NO: 305875 - DNA, 20 bp, Artificial Sequence
  Description of Artificial Sequence: Synthetic oligonucleotide
  Target: ATXN1; (+) strand; PAM type: YTN; PAM sequence: TTA
agttttgaagaatggaagtg

SEQ ID NO: 305876 - DNA, 20 bp, Artificial Sequence
  Description of Artificial Sequence: Synthetic oligonucleotide
  Target: ATXN1; (+) strand; PAM type: YTN; PAM sequence: TTT
tgaagaatggaagtggctat

SEQ ID NO: 305877 - DNA, 20 bp, Artificial Sequence
  Description of Artificial Sequence: Synthetic oligonucleotide
  Target: ATXN1; (+) strand; PAM type: YTN; PAM sequence: TTT
gaagaatggaagtggctata

SEQ ID NO: 305878 - DNA, 20 bp, Artificial Sequence
  Description of Artificial Sequence: Synthetic oligonucleotide
  Target: ATXN1; (+) strand; PAM type: YTN; PAM sequence: TTG
aagaatggaagtggctatat

SEQ ID NO: 305879 - DNA, 20 bp, Artificial Sequence
  Description of Artificial Sequence: Synthetic oligonucleotide
  Target: ATXN1; (+) strand; PAM type: YTN; PAM sequence: CTA
tatggttttataacatgatc

SEQ ID NO: 305880 - DNA, 20 bp, Artificial Sequence
  Description of Artificial Sequence: Synthetic oligonucleotide
  Target: ATXN1; (+) strand; PAM type: YTN; PAM sequence: TTT
tataacatgatcccttggaa

SEQ ID NO: 305881 - DNA, 20 bp, Artificial Sequence
  Description of Artificial Sequence: Synthetic oligonucleotide
  Target: ATXN1; (+) strand; PAM type: YTN; PAM sequence: TTT
ataacatgatcccttggaaa

SEQ ID NO: 305882 - DNA, 20 bp, Artificial Sequence
  Description of Artificial Sequence: Synthetic oligonucleotide
  Target: ATXN1; (+) strand; PAM type: YTN; PAM sequence: TTA
taacatgatcccttggaaaa

SEQ ID NO: 305883 - DNA, 20 bp, Artificial Sequence
  Description of Artificial Sequence: Synthetic oligonucleotide
  Target: ATXN1; (+) strand; PAM type: YTN; PAM sequence: CTT
ggaaaattaaaatgaaagta

SEQ ID NO: 305884 - DNA, 20 bp, Artificial Sequence
  Description of Artificial Sequence: Synthetic oligonucleotide
  Target: ATXN1; (+) strand; PAM type: YTN; PAM sequence: TTG
gaaaattaaaatgaaagtat

SEQ ID NO: 305885 - DNA, 20 bp, Artificial Sequence
  Description of Artificial Sequence: Synthetic oligonucleotide
  Target: ATXN1; (+) strand; PAM type: YTN; PAM sequence: TTA
aaatgaaagtatgttaactt

SEQ ID NO: 305886 - DNA, 20 bp, Artificial Sequence
  Description of Artificial Sequence: Synthetic oligonucleotide
  Target: ATXN1; (+) strand; PAM type: YTN; PAM sequence: TTA
acttcctatggctttaaatg

SEQ ID NO: 305887 - DNA, 20 bp, Artificial Sequence
  Description of Artificial Sequence: Synthetic oligonucleotide
  Target: ATXN1; (+) strand; PAM type: YTN; PAM sequence: CTT
cctatggctttaaatggtgt

SEQ ID NO: 305888 - DNA, 20 bp, Artificial Sequence
  Description of Artificial Sequence: Synthetic oligonucleotide
  Target: ATXN1; (+) strand; PAM type: YTN; PAM sequence: TTC
ctatggctttaaatggtgtg

SEQ ID NO: 305889 - DNA, 20 bp, Artificial Sequence
  Description of Artificial Sequence: Synthetic oligonucleotide
  Target: ATXN1; (+) strand; PAM type: YTN; PAM sequence: CTA
tggctttaaatggtgtgtct

SEQ ID NO: 305890 - DNA, 20 bp, Artificial Sequence
  Description of Artificial Sequence: Synthetic oligonucleotide
  Target: ATXN1; (+) strand; PAM type: YTN; PAM sequence: CTT
taaatggtgtgtcttgcttg

SEQ ID NO: 305891 - DNA, 20 bp, Artificial Sequence
  Description of Artificial Sequence: Synthetic oligonucleotide
  Target: ATXN1; (+) strand; PAM type: YTN; PAM sequence: TTT
aaatggtgtgtcttgcttgt

SEQ ID NO: 305892 - DNA, 20 bp, Artificial Sequence
  Description of Artificial Sequence: Synthetic oligonucleotide
  Target: ATXN1; (+) strand; PAM type: YTN; PAM sequence: TTA
aatggtgtgtcttgcttgta

SEQ ID NO: 305893 - DNA, 20 bp, Artificial Sequence
  Description of Artificial Sequence: Synthetic oligonucleotide
  Target: ATXN1; (+) strand; PAM type: YTN; PAM sequence: CTT
gcttgtaatgttggacactg

SEQ ID NO: 305894 - DNA, 20 bp, Artificial Sequence
  Description of Artificial Sequence: Synthetic oligonucleotide
  Target: ATXN1; (+) strand; PAM type: YTN; PAM sequence: TTG
cttgtaatgttggacactgg

SEQ ID NO: 305895 - DNA, 20 bp, Artificial Sequence
  Description of Artificial Sequence: Synthetic oligonucleotide
  Target: ATXN1; (+) strand; PAM type: YTN; PAM sequence: CTT
gtaatgttggacactggact

SEQ ID NO: 305896 - DNA, 20 bp, Artificial Sequence
  Description of Artificial Sequence: Synthetic oligonucleotide
  Target: ATXN1; (+) strand; PAM type: YTN; PAM sequence: TTG
taatgttggacactggactc

SEQ ID NO: 305897 - DNA, 20 bp, Artificial Sequence
  Description of Artificial Sequence: Synthetic oligonucleotide
  Target: ATXN1; (+) strand; PAM type: YTN; PAM sequence: TTG
gacactggactcctctagag

SEQ ID NO: 305898 - DNA, 20 bp, Artificial Sequence
  Description of Artificial Sequence: Synthetic oligonucleotide
  Target: ATXN1; (+) strand; PAM type: YTN; PAM sequence: CTG
gactcctctagagccttctt

SEQ ID NO: 305899 - DNA, 20 bp, Artificial Sequence
  Description of Artificial Sequence: Synthetic oligonucleotide
  Target: ATXN1; (+) strand; PAM type: YTN; PAM sequence: CTC
ctctagagccttcttaagta

SEQ ID NO: 305900 - DNA, 20 bp, Artificial Sequence
  Description of Artificial Sequence: Synthetic oligonucleotide
  Target: ATXN1; (+) strand; PAM type: YTN; PAM sequence: CTC
tagagccttcttaagtacga

SEQ ID NO: 305901 - DNA, 20 bp, Artificial Sequence
  Description of Artificial Sequence: Synthetic oligonucleotide
  Target: ATXN1; (+) strand; PAM type: YTN; PAM sequence: CTA
gagccttcttaagtacgaga

SEQ ID NO: 305902 - DNA, 20 bp, Artificial Sequence
  Description of Artificial Sequence: Synthetic oligonucleotide
  Target: ATXN1; (+) strand; PAM type: YTN; PAM sequence: CTT
cttaagtacgagagctgagt

SEQ ID NO: 305903 - DNA, 20 bp, Artificial Sequence
  Description of Artificial Sequence: Synthetic oligonucleotide
  Target: ATXN1; (+) strand; PAM type: YTN; PAM sequence: TTC
ttaagtacgagagctgagtt

SEQ ID NO: 305904 - DNA, 20 bp, Artificial Sequence
  Description of Artificial Sequence: Synthetic oligonucleotide
  Target: ATXN1; (+) strand; PAM type: YTN; PAM sequence: CTT
aagtacgagagctgagtttt

SEQ ID NO: 305905 - DNA, 20 bp, Artificial Sequence
  Description of Artificial Sequence: Synthetic oligonucleotide
  Target: ATXN1; (+) strand; PAM type: YTN; PAM sequence: TTA
agtacgagagctgagttttc

SEQ ID NO: 305906 - DNA, 20 bp, Artificial Sequence
  Description of Artificial Sequence: Synthetic oligonucleotide
  Target: ATXN1; (+) strand; PAM type: YTN; PAM sequence: CTG
agttttctgtgtttatttag

SEQ ID NO: 305907 - DNA, 20 bp, Artificial Sequence
  Description of Artificial Sequence: Synthetic oligonucleotide
  Target: ATXN1; (+) strand; PAM type: YTN; PAM sequence: TTT
tctgtgtttatttaggtttc

SEQ ID NO: 305908 - DNA, 20 bp, Artificial Sequence
  Description of Artificial Sequence: Synthetic oligonucleotide
  Target: ATXN1; (+) strand; PAM type: YTN; PAM sequence: TTT
ctgtgtttatttaggtttcg

SEQ ID NO: 305909 - DNA, 20 bp, Artificial Sequence
  Description of Artificial Sequence: Synthetic oligonucleotide
  Target: ATXN1; (+) strand; PAM type: YTN; PAM sequence: TTC
tgtgtttatttaggtttcga

SEQ ID NO: 305910 - DNA, 20 bp, Artificial Sequence
  Description of Artificial Sequence: Synthetic oligonucleotide
  Target: ATXN1; (+) strand; PAM type: YTN; PAM sequence: CTG
tgtttatttaggtttcgaga

SEQ ID NO: 305911 - DNA, 20 bp, Artificial Sequence
  Description of Artificial Sequence: Synthetic oligonucleotide
  Target: ATXN1; (+) strand; PAM type: YTN; PAM sequence: TTT
atttaggtttcgagaactgc

SEQ ID NO: 305912 - DNA, 20 bp, Artificial Sequence
  Description of Artificial Sequence: Synthetic oligonucleotide
  Target: ATXN1; (+) strand; PAM type: YTN; PAM sequence: TTA
tttaggtttcgagaactgct

SEQ ID NO: 305913 - DNA, 20 bp, Artificial Sequence
  Description of Artificial Sequence: Synthetic oligonucleotide
  Target: ATXN1; (+) strand; PAM type: YTN; PAM sequence: TTT
aggtttcgagaactgctatt

SEQ ID NO: 305914 - DNA, 20 bp, Artificial Sequence
  Description of Artificial Sequence: Synthetic oligonucleotide
  Target: ATXN1; (+) strand; PAM type: YTN; PAM sequence: TTA
ggtttcgagaactgctattt

SEQ ID NO: 305915 - DNA, 20 bp, Artificial Sequence
  Description of Artificial Sequence: Synthetic oligonucleotide
  Target: ATXN1; (+) strand; PAM type: YTN; PAM sequence: TTT
cgagaactgctatttattac

SEQ ID NO: 305916 - DNA, 20 bp, Artificial Sequence
  Description of Artificial Sequence: Synthetic oligonucleotide
  Target: ATXN1; (+) strand; PAM type: YTN; PAM sequence: TTC
gagaactgctatttattact

SEQ ID NO: 305917 - DNA, 20 bp, Artificial Sequence
  Description of Artificial Sequence: Synthetic oligonucleotide
  Target: ATXN1; (+) strand; PAM type: YTN; PAM sequence: CTG
ctatttattactccgatact

SEQ ID NO: 305918 - DNA, 20 bp, Artificial Sequence
  Description of Artificial Sequence: Synthetic oligonucleotide
  Target: ATXN1; (+) strand; PAM type: YTN; PAM sequence: CTA
tttattactccgatactgcg

SEQ ID NO: 305919 - DNA, 20 bp, Artificial Sequence
  Description of Artificial Sequence: Synthetic oligonucleotide
  Target: ATXN1; (+) strand; PAM type: YTN; PAM sequence: TTT
attactccgatactgcgtgt

SEQ ID NO: 305920 - DNA, 20 bp, Artificial Sequence
  Description of Artificial Sequence: Synthetic oligonucleotide
  Target: ATXN1; (+) strand; PAM type: YTN; PAM sequence: TTA
ttactccgatactgcgtgtt

SEQ ID NO: 305921 - DNA, 20 bp, Artificial Sequence
  Description of Artificial Sequence: Synthetic oligonucleotide
  Target: ATXN1; (+) strand; PAM type: YTN; PAM sequence: TTA
ctccgatactgcgtgttttc

SEQ ID NO: 305922 - DNA, 20 bp, Artificial Sequence
  Description of Artificial Sequence: Synthetic oligonucleotide
  Target: ATXN1; (+) strand; PAM type: YTN; PAM sequence: CTC
cgatactgcgtgttttcatt

SEQ ID NO: 305923 - DNA, 20 bp, Artificial Sequence
  Description of Artificial Sequence: Synthetic oligonucleotide
  Target: ATXN1; (+) strand; PAM type: YTN; PAM sequence: CTG
cgtgttttcattccagagga

SEQ ID NO: 305924 - DNA, 20 bp, Artificial Sequence
  Description of Artificial Sequence: Synthetic oligonucleotide
  Target: ATXN1; (+) strand; PAM type: YTN; PAM sequence: TTT
tcattccagaggagtgtgat

SEQ ID NO: 305925 - DNA, 20 bp, Artificial Sequence
  Description of Artificial Sequence: Synthetic oligonucleotide
  Target: ATXN1; (+) strand; PAM type: YTN; PAM sequence: TTT
cattccagaggagtgtgatt

SEQ ID NO: 305926 - DNA, 20 bp, Artificial Sequence
  Description of Artificial Sequence: Synthetic oligonucleotide
  Target: ATXN1; (+) strand; PAM type: YTN; PAM sequence: TTC
attccagaggagtgtgattg

SEQ ID NO: 305927 - DNA, 20 bp, Artificial Sequence
  Description of Artificial Sequence: Synthetic oligonucleotide
  Target: ATXN1; (+) strand; PAM type: YTN; PAM sequence: TTC
cagaggagtgtgattgttaa

SEQ ID NO: 305928 - DNA, 20 bp, Artificial Sequence
  Description of Artificial Sequence: Synthetic oligonucleotide
  Target: ATXN1; (+) strand; PAM type: YTN; PAM sequence: TTG
ttaatttgttattgcgagtt

SEQ ID NO: 305929 - DNA, 20 bp, Artificial Sequence
  Description of Artificial Sequence: Synthetic oligonucleotide
  Target: ATXN1; (+) strand; PAM type: YTN; PAM sequence: TTA
atttgttattgcgagttcct

SEQ ID NO: 305930 - DNA, 20 bp, Artificial Sequence
  Description of Artificial Sequence: Synthetic oligonucleotide
  Target: ATXN1; (+) strand; PAM type: YTN; PAM sequence: TTT
gttattgcgagttccttaag

SEQ ID NO: 305931 - DNA, 20 bp, Artificial Sequence
  Description of Artificial Sequence: Synthetic oligonucleotide
  Target: ATXN1; (+) strand; PAM type: YTN; PAM sequence: TTG
ttattgcgagttccttaagg

SEQ ID NO: 305932 - DNA, 20 bp, Artificial Sequence
  Description of Artificial Sequence: Synthetic oligonucleotide
  Target: ATXN1; (+) strand; PAM type: YTN; PAM sequence: TTA
ttgcgagttccttaaggagt

SEQ ID NO: 305933 - DNA, 20 bp, Artificial Sequence
  Description of Artificial Sequence: Synthetic oligonucleotide
  Target: ATXN1; (+) strand; PAM type: YTN; PAM sequence: TTG
cgagttccttaaggagtcaa

SEQ ID NO: 305934 - DNA, 20 bp, Artificial Sequence
  Description of Artificial Sequence: Synthetic oligonucleotide
  Target: ATXN1; (+) strand; PAM type: YTN; PAM sequence: TTC
cttaaggagtcaaaacatcc

SEQ ID NO: 305935 - DNA, 20 bp, Artificial Sequence
  Description of Artificial Sequence: Synthetic oligonucleotide
  Target: ATXN1; (+) strand; PAM type: YTN; PAM sequence: CTT
aaggagtcaaaacatccaga

SEQ ID NO: 305936 - DNA, 20 bp, Artificial Sequence
  Description of Artificial Sequence: Synthetic oligonucleotide
  Target: ATXN1; (+) strand; PAM type: YTN; PAM sequence: TTA
aggagtcaaaacatccagag

SEQ ID NO: 305937 - DNA, 20 bp, Artificial Sequence
  Description of Artificial Sequence: Synthetic oligonucleotide
  Target: ATXN1; (+) strand; PAM type: YTN; PAM sequence: CTA
cacacagcaataaaggctag

SEQ ID NO: 305938 - DNA, 20 bp, Artificial Sequence
  Description of Artificial Sequence: Synthetic oligonucleotide
  Target: ATXN1; (+) strand; PAM type: YTN; PAM sequence: CTA
gaaaatgtctcaacaacatg

SEQ ID NO: 305939 - DNA, 20 bp, Artificial Sequence
  Description of Artificial Sequence: Synthetic oligonucleotide
  Target: ATXN1; (+) strand; PAM type: YTN; PAM sequence: CTC
aacaacatggaaatgactca

SEQ ID NO: 305940 - DNA, 20 bp, Artificial Sequence
  Description of Artificial Sequence: Synthetic oligonucleotide
  Target: ATXN1; (+) strand; PAM type: YTN; PAM sequence: CTC
actgctaaagacatggggga

SEQ ID NO: 305941 - DNA, 20 bp, Artificial Sequence
  Description of Artificial Sequence: Synthetic oligonucleotide
  Target: ATXN1; (+) strand; PAM type: YTN; PAM sequence: CTG
ctaaagacatgggggattaa

SEQ ID NO: 305942 - DNA, 20 bp, Artificial Sequence
  Description of Artificial Sequence: Synthetic oligonucleotide
  Target: ATXN1; (+) strand; PAM type: YTN; PAM sequence: CTA
aagacatgggggattaagaa

SEQ ID NO: 305943 - DNA, 20 bp, Artificial Sequence
  Description of Artificial Sequence: Synthetic oligonucleotide
  Target: ATXN1; (+) strand; PAM type: YTN; PAM sequence: TTA
agaaacactctcccattcaa

SEQ ID NO: 305944 - DNA, 20 bp, Artificial Sequence
  Description of Artificial Sequence: Synthetic oligonucleotide
  Target: ATXN1; (+) strand; PAM type: YTN; PAM sequence: CTC
tcccattcaattcagggtaa

SEQ ID NO: 305945 - DNA, 20 bp, Artificial Sequence
  Description of Artificial Sequence: Synthetic oligonucleotide
  Target: ATXN1; (+) strand; PAM type: YTN; PAM sequence: CTC
ccattcaattcagggtaaat

SEQ ID NO: 305946 - DNA, 20 bp, Artificial Sequence
  Description of Artificial Sequence: Synthetic oligonucleotide
  Target: ATXN1; (+) strand; PAM type: YTN; PAM sequence: TTC
aattcagggtaaatttgttc

SEQ ID NO: 305947 - DNA, 20 bp, Artificial Sequence
  Description of Artificial Sequence: Synthetic oligonucleotide
  Target: ATXN1; (+) strand; PAM type: YTN; PAM sequence: TTC
agggtaaatttgttcagatg

SEQ ID NO: 305948 - DNA, 20 bp, Artificial Sequence
  Description of Artificial Sequence: Synthetic oligonucleotide
  Target: ATXN1; (+) strand; PAM type: YTN; PAM sequence: TTT
gttcagatgaaacaaacaag

SEQ ID NO: 305949 - DNA, 20 bp, Artificial Sequence
  Description of Artificial Sequence: Synthetic oligonucleotide
  Target: ATXN1; (+) strand; PAM type: YTN; PAM sequence: TTG
ttcagatgaaacaaacaaga

SEQ ID NO: 305950 - DNA, 20 bp, Artificial Sequence
  Description of Artificial Sequence: Synthetic oligonucleotide
  Target: ATXN1; (+) strand; PAM type: YTN; PAM sequence: TTC
agatgaaacaaacaagaaaa

SEQ ID NO: 305951 - DNA, 20 bp, Artificial Sequence
  Description of Artificial Sequence: Synthetic oligonucleotide
  Target: ATXN1; (+) strand; PAM type: YTN; PAM sequence: CTA
aatccagtttttgaatcaga

SEQ ID NO: 305952 - DNA, 20 bp, Artificial Sequence
  Description of Artificial Sequence: Synthetic oligonucleotide
  Target: ATXN1; (+) strand; PAM type: YTN; PAM sequence: TTT
ttgaatcagaaaccgaattt

SEQ ID NO: 305953 - DNA, 20 bp, Artificial Sequence
  Description of Artificial Sequence: Synthetic oligonucleotide
  Target: ATXN1; (+) strand; PAM type: YTN; PAM sequence: TTT
tgaatcagaaaccgaattta

SEQ ID NO: 305954 - DNA, 20 bp, Artificial Sequence
  Description of Artificial Sequence: Synthetic oligonucleotide
  Target: ATXN1; (+) strand; PAM type: YTN; PAM sequence: TTT
gaatcagaaaccgaatttag

SEQ ID NO: 305955 - DNA, 20 bp, Artificial Sequence
  Description of Artificial Sequence: Synthetic oligonucleotide
  Target: ATXN1; (+) strand; PAM type: YTN; PAM sequence: TTG
aatcagaaaccgaatttaga

SEQ ID NO: 305956 - DNA, 20 bp, Artificial Sequence
  Description of Artificial Sequence: Synthetic oligonucleotide
  Target: ATXN1; (+) strand; PAM type: YTN; PAM sequence: TTT
agaaaaacatcttggttgaa

SEQ ID NO: 305957 - DNA, 20 bp, Artificial Sequence
  Description of Artificial Sequence: Synthetic oligonucleotide
  Target: ATXN1; (+) strand; PAM type: YTN; PAM sequence: TTA
gaaaaacatcttggttgaaa

SEQ ID NO: 305958 - DNA, 20 bp, Artificial Sequence
  Description of Artificial Sequence: Synthetic oligonucleotide
  Target: ATXN1; (+) strand; PAM type: YTN; PAM sequence: CTT
ggttgaaatgccctgtgaaa

SEQ ID NO: 305959 - DNA, 20 bp, Artificial Sequence
  Description of Artificial Sequence: Synthetic oligonucleotide
  Target: ATXN1; (+) strand; PAM type: YTN; PAM sequence: TTG
gttgaaatgccctgtgaaaa

SEQ ID NO: 305960 - DNA, 20 bp, Artificial Sequence
  Description of Artificial Sequence: Synthetic oligonucleotide
  Target: ATXN1; (+) strand; PAM type: YTN; PAM sequence: TTG
aaatgccctgtgaaaatagt

SEQ ID NO: 305961 - DNA, 20 bp, Artificial Sequence
  Description of Artificial Sequence: Synthetic oligonucleotide
  Target: ATXN1; (+) strand; PAM type: YTN; PAM sequence: CTG
tgaaaatagttttaaagtat

SEQ ID NO: 305962 - DNA, 20 bp, Artificial Sequence
  Description of Artificial Sequence: Synthetic oligonucleotide
  Target: ATXN1; (+) strand; PAM type: YTN; PAM sequence: TTT
taaagtatttctcttccttc

SEQ ID NO: 305963 - DNA, 20 bp, Artificial Sequence
  Description of Artificial Sequence: Synthetic oligonucleotide
  Target: ATXN1; (+) strand; PAM type: YTN; PAM sequence: TTT
aaagtatttctcttccttcc

SEQ ID NO: 305964 - DNA, 20 bp, Artificial Sequence
  Description of Artificial Sequence: Synthetic oligonucleotide
  Target: ATXN1; (+) strand; PAM type: YTN; PAM sequence: TTA
aagtatttctcttccttcct

SEQ ID NO: 305965 - DNA, 20 bp, Artificial Sequence
  Description of Artificial Sequence: Synthetic oligonucleotide
  Target: ATXN1; (+) strand; PAM type: YTN; PAM sequence: TTT
ctcttccttcctctcatcag

SEQ ID NO: 305966 - DNA, 20 bp, Artificial Sequence
  Description of Artificial Sequence: Synthetic oligonucleotide
  Target: ATXN1; (+) strand; PAM type: YTN; PAM sequence: TTC
tcttccttcctctcatcagt

SEQ ID NO: 305967 - DNA, 20 bp, Artificial Sequence
  Description of Artificial Sequence: Synthetic oligonucleotide
  Target: ATXN1; (+) strand; PAM type: YTN; PAM sequence: CTC
ttccttcctctcatcagtaa

SEQ ID NO: 305968 - DNA, 20 bp, Artificial Sequence
  Description of Artificial Sequence: Synthetic oligonucleotide
  Target: ATXN1; (+) strand; PAM type: YTN; PAM sequence: CTT
ccttcctctcatcagtaagg

SEQ ID NO: 305969 - DNA, 20 bp, Artificial Sequence
  Description of Artificial Sequence: Synthetic oligonucleotide
  Target: ATXN1; (+) strand; PAM type: YTN; PAM sequence: TTC
cttcctctcatcagtaaggt

SEQ ID NO: 305970 - DNA, 20 bp, Artificial Sequence
  Description of Artificial Sequence: Synthetic oligonucleotide
  Target: ATXN1; (+) strand; PAM type: YTN; PAM sequence: CTT
cctctcatcagtaaggtcaa

SEQ ID NO: 305971 - DNA, 20 bp, Artificial Sequence
  Description of Artificial Sequence: Synthetic oligonucleotide
  Target: ATXN1; (+) strand; PAM type: YTN; PAM sequence: TTC
ctctcatcagtaaggtcaat

SEQ ID NO: 305972 - DNA, 20 bp, Artificial Sequence
  Description of Artificial Sequence: Synthetic oligonucleotide
  Target: ATXN1; (+) strand; PAM type: YTN; PAM sequence: CTC
tcatcagtaaggtcaataat

SEQ ID NO: 305973 - DNA, 20 bp, Artificial Sequence
  Description of Artificial Sequence: Synthetic oligonucleotide
  Target: ATXN1; (+) strand; PAM type: YTN; PAM sequence: CTC
atcagtaaggtcaataatca

SEQ ID NO: 305974 - DNA, 20 bp, Artificial Sequence
  Description of Artificial Sequence: Synthetic oligonucleotide
  Target: ATXN1; (+) strand; PAM type: YTN; PAM sequence: CTT
gcactcattgtgcatatttg

SEQ ID NO: 305975 - DNA, 20 bp, Artificial Sequence
  Description of Artificial Sequence: Synthetic oligonucleotide
  Target: ATXN1; (+) strand; PAM type: YTN; PAM sequence: TTG
cactcattgtgcatatttgg

SEQ ID NO: 305976 - DNA, 20 bp, Artificial Sequence
  Description of Artificial Sequence: Synthetic oligonucleotide
  Target: ATXN1; (+) strand; PAM type: YTN; PAM sequence: CTC
attgtgcatatttggcccag

SEQ ID NO: 305977 - DNA, 20 bp, Artificial Sequence
  Description of Artificial Sequence: Synthetic oligonucleotide
  Target: ATXN1; (+) strand; PAM type: YTN; PAM sequence: TTG
tgcatatttggcccagtagc

SEQ ID NO: 305978 - DNA, 20 bp, Artificial Sequence
  Description of Artificial Sequence: Synthetic oligonucleotide
  Target: ATXN1; (+) strand; PAM type: YTN; PAM sequence: TTT
ggcccagtagctactcccac

SEQ ID NO: 305979 - DNA, 20 bp, Artificial Sequence
  Description of Artificial Sequence: Synthetic oligonucleotide
  Target: ATXN1; (+) strand; PAM type: YTN; PAM sequence: TTG
gcccagtagctactcccaca

SEQ ID NO: 305980 - DNA, 20 bp, Artificial Sequence
  Description of Artificial Sequence: Synthetic oligonucleotide
  Target: ATXN1; (+) strand; PAM type: YTN; PAM sequence: CTA
ctcccacattctcacattca

SEQ ID NO: 305981 - DNA, 20 bp, Artificial Sequence
  Description of Artificial Sequence: Synthetic oligonucleotide
  Target: ATXN1; (+) strand; PAM type: YTN; PAM sequence: CTC
ccacattctcacattcaaca

SEQ ID NO: 305982 - DNA, 20 bp, Artificial Sequence
  Description of Artificial Sequence: Synthetic oligonucleotide
  Target: ATXN1; (+) strand; PAM type: YTN; PAM sequence: TTC
tcacattcaacaatatttat

SEQ ID NO: 305983 - DNA, 20 bp, Artificial Sequence
  Description of Artificial Sequence: Synthetic oligonucleotide
  Target: ATXN1; (+) strand; PAM type: YTN; PAM sequence: CTC
acattcaacaatatttatgc

SEQ ID NO: 305984 - DNA, 20 bp, Artificial Sequence
  Description of Artificial Sequence: Synthetic oligonucleotide
  Target: ATXN1; (+) strand; PAM type: YTN; PAM sequence: TTC
aacaatatttatgcccagat

SEQ ID NO: 305985 - DNA, 20 bp, Artificial Sequence
  Description of Artificial Sequence: Synthetic oligonucleotide
  Target: ATXN1; (+) strand; PAM type: YTN; PAM sequence: TTT
atgcccagataagggagaga

SEQ ID NO: 305986 - DNA, 20 bp, Artificial Sequence
  Description of Artificial Sequence: Synthetic oligonucleotide
  Target: ATXN1; (+) strand; PAM type: YTN; PAM sequence: TTA
tgcccagataagggagagaa

SEQ ID NO: 305987 - DNA, 20 bp, Artificial Sequence
  Description of Artificial Sequence: Synthetic oligonucleotide
  Target: ATXN1; (+) strand; PAM type: YTN; PAM sequence: CTT
tcacaagctgactatgttta

SEQ ID NO: 305988 - DNA, 20 bp, Artificial Sequence
  Description of Artificial Sequence: Synthetic oligonucleotide
  Target: ATXN1; (+) strand; PAM type: YTN; PAM sequence: TTT
cacaagctgactatgtttat

SEQ ID NO: 305989 - DNA, 20 bp, Artificial Sequence
  Description of Artificial Sequence: Synthetic oligonucleotide
  Target: ATXN1; (+) strand; PAM type: YTN; PAM sequence: TTC
acaagctgactatgtttatt

SEQ ID NO: 305990 - DNA, 20 bp, Artificial Sequence
  Description of Artificial Sequence: Synthetic oligonucleotide
  Target: ATXN1; (+) strand; PAM type: YTN; PAM sequence: CTG
actatgtttattccaacatt

SEQ ID NO: 305991 - DNA, 20 bp, Artificial Sequence
  Description of Artificial Sequence: Synthetic oligonucleotide
  Target: ATXN1; (+) strand; PAM type: YTN; PAM sequence: CTA
tgtttattccaacattttcc

SEQ ID NO: 305992 - DNA, 20 bp, Artificial Sequence
  Description of Artificial Sequence: Synthetic oligonucleotide
  Target: ATXN1; (+) strand; PAM type: YTN; PAM sequence: TTT
attccaacattttcctgcac

SEQ ID NO: 305993 - DNA, 20 bp, Artificial Sequence
  Description of Artificial Sequence: Synthetic oligonucleotide
  Target: ATXN1; (+) strand; PAM type: YTN; PAM sequence: TTA
ttccaacattttcctgcacc

SEQ ID NO: 305994 - DNA, 20 bp, Artificial Sequence
  Description of Artificial Sequence: Synthetic oligonucleotide
  Target: ATXN1; (+) strand; PAM type: YTN; PAM sequence: TTC
caacattttcctgcaccatt

SEQ ID NO: 305995 - DNA, 20 bp, Artificial Sequence
  Description of Artificial Sequence: Synthetic oligonucleotide
  Target: ATXN1; (+) strand; PAM type: YTN; PAM sequence: TTT
tcctgcaccattttaaagga

SEQ ID NO: 305996 - DNA, 20 bp, Artificial Sequence
  Description of Artificial Sequence: Synthetic oligonucleotide
  Target: ATXN1; (+) strand; PAM type: YTN; PAM sequence: TTT
cctgcaccattttaaaggaa

SEQ ID NO: 305997 - DNA, 20 bp, Artificial Sequence
  Description of Artificial Sequence: Synthetic oligonucleotide
  Target: ATXN1; (+) strand; PAM type: YTN; PAM sequence: TTC
ctgcaccattttaaaggaag

SEQ ID NO: 305998 - DNA, 20 bp, Artificial Sequence
  Description of Artificial Sequence: Synthetic oligonucleotide
  Target: ATXN1; (+) strand; PAM type: YTN; PAM sequence: CTG
caccattttaaaggaagaga

SEQ ID NO: 305999 - DNA, 20 bp, Artificial Sequence
  Description of Artificial Sequence: Synthetic oligonucleotide
  Target: ATXN1; (+) strand; PAM type: YTN; PAM sequence: TTT
taaaggaagagaaaaaaagc

SEQ ID NO: 306000 - DNA, 20 bp, Artificial Sequence
  Description of Artificial Sequence: Synthetic oligonucleotide
  Target: ATXN1; (+) strand; PAM type: YTN; PAM sequence: TTT
aaaggaagagaaaaaaagca

SEQ ID NO: 306001 - DNA, 20 bp, Artificial Sequence
  Description of Artificial Sequence: Synthetic oligonucleotide
  Target: ATXN1; (+) strand; PAM type: YTN; PAM sequence: TTA
aaggaagagaaaaaaagcat

SEQ ID NO: 306002 - DNA, 20 bp, Artificial Sequence
  Description of Artificial Sequence: Synthetic oligonucleotide
  Target: ATXN1; (+) strand; PAM type: YTN; PAM sequence: CTT
aagcgctcctaagggaaaag

SEQ ID NO: 306003 - DNA, 20 bp, Artificial Sequence
  Description of Artificial Sequence: Synthetic oligonucleotide
  Target: ATXN1; (+) strand; PAM type: YTN; PAM sequence: TTA
agcgctcctaagggaaaaga

SEQ ID NO: 306004 - DNA, 20 bp, Artificial Sequence
  Description of Artificial Sequence: Synthetic oligonucleotide
  Target: ATXN1; (+) strand; PAM type: YTN; PAM sequence: CTC
ctaagggaaaagactcaata

SEQ ID NO: 306005 - DNA, 20 bp, Artificial Sequence
  Description of Artificial Sequence: Synthetic oligonucleotide
  Target: ATXN1; (+) strand; PAM type: YTN; PAM sequence: CTA
agggaaaagactcaatacat

SEQ ID NO: 306006 - DNA, 20 bp, Artificial Sequence
  Description of Artificial Sequence: Synthetic oligonucleotide
  Target: ATXN1; (+) strand; PAM type: YTN; PAM sequence: CTC
aatacatacagaccttttta

SEQ ID NO: 306007 - DNA, 20 bp, Artificial Sequence
  Description of Artificial Sequence: Synthetic oligonucleotide
  Target: ATXN1; (+) strand; PAM type: YTN; PAM sequence: CTT
tttaatcaattcagatccaa

SEQ ID NO: 306008 - DNA, 20 bp, Artificial Sequence
  Description of Artificial Sequence: Synthetic oligonucleotide
  Target: ATXN1; (+) strand; PAM type: YTN; PAM sequence: TTT
ttaatcaattcagatccaag

SEQ ID NO: 306009 - DNA, 20 bp, Artificial Sequence
  Description of Artificial Sequence: Synthetic oligonucleotide
  Target: ATXN1; (+) strand; PAM type: YTN; PAM sequence: TTT
taatcaattcagatccaagt

SEQ ID NO: 306010 - DNA, 20 bp, Artificial Sequence
  Description of Artificial Sequence: Synthetic oligonucleotide
  Target: ATXN1; (+) strand; PAM type: YTN; PAM sequence: TTT
aatcaattcagatccaagta

SEQ ID NO: 306011 - DNA, 20 bp, Artificial Sequence
  Description of Artificial Sequence: Synthetic oligonucleotide
  Target: ATXN1; (+) strand; PAM type: YTN; PAM sequence: TTA
atcaattcagatccaagtac

SEQ ID NO: 306012 - DNA, 20 bp, Artificial Sequence
  Description of Artificial Sequence: Synthetic oligonucleotide
  Target: ATXN1; (+) strand; PAM type: YTN; PAM sequence: TTC
agatccaagtacacaaggaa

SEQ ID NO: 306013 - DNA, 20 bp, Artificial Sequence
  Description of Artificial Sequence: Synthetic oligonucleotide
  Target: ATXN1; (+) strand; PAM type: YTN; PAM sequence: CTG
gtaaatatttgctaaataaa

SEQ ID NO: 306014 - DNA, 20 bp, Artificial Sequence
  Description of Artificial Sequence: Synthetic oligonucleotide
  Target: ATXN1; (+) strand; PAM type: YTN; PAM sequence: TTT
gctaaataaaggcagctgat

SEQ ID NO: 306015 - DNA, 20 bp, Artificial Sequence
  Description of Artificial Sequence: Synthetic oligonucleotide
  Target: ATXN1; (+) strand; PAM type: YTN; PAM sequence: TTG
ctaaataaaggcagctgata

SEQ ID NO: 306016 - DNA, 20 bp, Artificial Sequence
  Description of Artificial Sequence: Synthetic oligonucleotide
  Target: ATXN1; (+) strand; PAM type: YTN; PAM sequence: CTA
aataaaggcagctgatattt

SEQ ID NO: 306017 - DNA, 20 bp, Artificial Sequence
  Description of Artificial Sequence: Synthetic oligonucleotide
  Target: ATXN1; (+) strand; PAM type: YTN; PAM sequence: CTG
atatttctctgcccgctttg

SEQ ID NO: 306018 - DNA, 20 bp, Artificial Sequence
  Description of Artificial Sequence: Synthetic oligonucleotide
  Target: ATXN1; (+) strand; PAM type: YTN; PAM sequence: TTT
ctctgcccgctttgccccta

SEQ ID NO: 306019 - DNA, 20 bp, Artificial Sequence
  Description of Artificial Sequence: Synthetic oligonucleotide
  Target: ATXN1; (+) strand; PAM type: YTN; PAM sequence: TTC
tctgcccgctttgcccctag

SEQ ID NO: 306020 - DNA, 20 bp, Artificial Sequence
  Description of Artificial Sequence: Synthetic oligonucleotide
  Target: ATXN1; (+) strand; PAM type: YTN; PAM sequence: CTC
tgcccgctttgcccctagcc

SEQ ID NO: 306021 - DNA, 20 bp, Artificial Sequence
  Description of Artificial Sequence: Synthetic oligonucleotide
  Target: ATXN1; (+) strand; PAM type: YTN; PAM sequence: CTG
cccgctttgcccctagccct

SEQ ID NO: 306022 - DNA, 20 bp, Artificial Sequence
  Description of Artificial Sequence: Synthetic oligonucleotide
  Target: ATXN1; (+) strand; PAM type: YTN; PAM sequence: CTT
tgcccctagccctctgactc

SEQ ID NO: 306023 - DNA, 20 bp, Artificial Sequence
  Description of Artificial Sequence: Synthetic oligonucleotide
  Target: ATXN1; (+) strand; PAM type: YTN; PAM sequence: TTT
gcccctagccctctgactcc

SEQ ID NO: 306024 - DNA, 20 bp, Artificial Sequence
  Description of Artificial Sequence: Synthetic oligonucleotide
  Target: ATXN1; (+) strand; PAM type: YTN; PAM sequence: TTG
cccctagccctctgactcct

SEQ ID NO: 306025 - DNA, 20 bp, Artificial Sequence
  Description of Artificial Sequence: Synthetic oligonucleotide
  Target: ATXN1; (+) strand; PAM type: YTN; PAM sequence: CTA
gccctctgactcctcctccc

SEQ ID NO: 306026 - DNA, 20 bp, Artificial Sequence
  Description of Artificial Sequence: Synthetic oligonucleotide
  Target: ATXN1; (+) strand; PAM type: YTN; PAM sequence: CTC
tgactcctcctccccacaat

SEQ ID NO: 306027 - DNA, 20 bp, Artificial Sequence
  Description of Artificial Sequence: Synthetic oligonucleotide
  Target: ATXN1; (+) strand; PAM type: YTN; PAM sequence: CTG
actcctcctccccacaatac

SEQ ID NO: 306028 - DNA, 20 bp, Artificial Sequence
  Description of Artificial Sequence: Synthetic oligonucleotide
  Target: ATXN1; (+) strand; PAM type: YTN; PAM sequence: CTC
ctcctccccacaatacccac

SEQ ID NO: 306029 - DNA, 20 bp, Artificial Sequence
  Description of Artificial Sequence: Synthetic oligonucleotide
  Target: ATXN1; (+) strand; PAM type: YTN; PAM sequence: CTC
ctccccacaatacccacata

SEQ ID NO: 306030 - DNA, 20 bp, Artificial Sequence
  Description of Artificial Sequence: Synthetic oligonucleotide
  Target: ATXN1; (+) strand; PAM type: YTN; PAM sequence: CTC
cccacaatacccacataatt

SEQ ID NO: 306031 - DNA, 20 bp, Artificial Sequence
  Description of Artificial Sequence: Synthetic oligonucleotide
  Target: ATXN1; (+) strand; PAM type: YTN; PAM sequence: TTT
tccttttggccataatatag

SEQ ID NO: 306032 - DNA, 20 bp, Artificial Sequence
  Description of Artificial Sequence: Synthetic oligonucleotide
  Target: ATXN1; (+) strand; PAM type: YTN; PAM sequence: TTT
ccttttggccataatataga

SEQ ID NO: 306033 - DNA, 20 bp, Artificial Sequence
  Description of Artificial Sequence: Synthetic oligonucleotide
  Target: ATXN1; (+) strand; PAM type: YTN; PAM sequence: TTC
cttttggccataatatagaa

SEQ ID NO: 306034 - DNA, 20 bp, Artificial Sequence
  Description of Artificial Sequence: Synthetic oligonucleotide
  Target: ATXN1; (+) strand; PAM type: YTN; PAM sequence: CTT
ttggccataatatagaactc

SEQ ID NO: 306035 - DNA, 20 bp, Artificial Sequence
  Description of Artificial Sequence: Synthetic oligonucleotide
  Target: ATXN1; (+) strand; PAM type: YTN; PAM sequence: TTT
tggccataatatagaactca

SEQ ID NO: 306036 - DNA, 20 bp, Artificial Sequence
  Description of Artificial Sequence: Synthetic oligonucleotide
  Target: ATXN1; (+) strand; PAM type: YTN; PAM sequence: TTT
ggccataatatagaactcaa

SEQ ID NO: 306037 - DNA, 20 bp, Artificial Sequence
  Description of Artificial Sequence: Synthetic oligonucleotide
  Target: ATXN1; (+) strand; PAM type: YTN; PAM sequence: TTG
gccataatatagaactcaat

SEQ ID NO: 306038 - DNA, 20 bp, Artificial Sequence
  Description of Artificial Sequence: Synthetic oligonucleotide
  Target: ATXN1; (+) strand; PAM type: YTN; PAM sequence: CTC
aatcaccatattaagatgaa

SEQ ID NO: 306039 - DNA, 20 bp, Artificial Sequence
  Description of Artificial Sequence: Synthetic oligonucleotide
  Target: ATXN1; (+) strand; PAM type: YTN; PAM sequence: TTA
agatgaagccctagaaagta

SEQ ID NO: 306040 - DNA, 20 bp, Artificial Sequence
  Description of Artificial Sequence: Synthetic oligonucleotide
  Target: ATXN1; (+) strand; PAM type: YTN; PAM sequence: CTA
gaaagtagcttcttataccc

SEQ ID NO: 306041 - DNA, 20 bp, Artificial Sequence
  Description of Artificial Sequence: Synthetic oligonucleotide
  Target: ATXN1; (+) strand; PAM type: YTN; PAM sequence: CTT
cttataccctgtgaactgta

SEQ ID NO: 306042 - DNA, 20 bp, Artificial Sequence
  Description of Artificial Sequence: Synthetic oligonucleotide
  Target: ATXN1; (+) strand; PAM type: YTN; PAM sequence: TTC
ttataccctgtgaactgtaa

SEQ ID NO: 306043 - DNA, 20 bp, Artificial Sequence
  Description of Artificial Sequence: Synthetic oligonucleotide
  Target: ATXN1; (+) strand; PAM type: YTN; PAM sequence: CTT
ataccctgtgaactgtaaga

SEQ ID NO: 306044 - DNA, 20 bp, Artificial Sequence
  Description of Artificial Sequence: Synthetic oligonucleotide
  Target: ATXN1; (+) strand; PAM type: YTN; PAM sequence: TTA
taccctgtgaactgtaagag

SEQ ID NO: 306045 - DNA, 20 bp, Artificial Sequence
  Description of Artificial Sequence: Synthetic oligonucleotide
  Target: ATXN1; (+) strand; PAM type: YTN; PAM sequence: CTG
tgaactgtaagagggagggg

SEQ ID NO: 306046 - DNA, 20 bp, Artificial Sequence
  Description of Artificial Sequence: Synthetic oligonucleotide
  Target: ATXN1; (+) strand; PAM type: YTN; PAM sequence: CTG
taagagggaggggttccagc

SEQ ID NO: 306047 - DNA, 20 bp, Artificial Sequence
  Description of Artificial Sequence: Synthetic oligonucleotide
  Target: ATXN1; (+) strand; PAM type: YTN; PAM sequence: TTC
cagccgggcacagtggctca

SEQ ID NO: 306048 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 306049 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 306050 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcaggcgg

SEQ ID NO: 306051 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcaggcgga

SEQ ID NO: 306052 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcaggcggat

SEQ ID NO: 306053 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcaagacca

SEQ ID NO: 306054 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctggccaacat

SEQ ID NO: 306055 - DNA, 20 bp, Artificial Sequence
  Description of Artificial Sequence: Synthetic oligonucleotide
  Target: ATXN1; (+) strand; PAM type: YTN; PAM sequence: CTG
gccaacatggcaaaacccca

SEQ ID NO: 306056 - DNA, 20 bp, Artificial Sequence
  Description of Artificial Sequence: Synthetic oligonucleotide
  Target: ATXN1; (+) strand; PAM type: YTN; PAM sequence: CTC
tactaaaatacaaaaattag

SEQ ID NO: 306057 - DNA, 20 bp, Artificial Sequence
  Description of Artificial Sequence: Synthetic oligonucleotide
  Target: ATXN1; (+) strand; PAM type: YTN; PAM sequence: CTA
ctaaaatacaaaaattagct

SEQ ID NO: 306058 - DNA, 20 bp, Artificial Sequence
  Description of Artificial Sequence: Synthetic oligonucleotide
  Target: ATXN1; (+) strand; PAM type: YTN; PAM sequence: CTA
aaatacaaaaattagctggg

SEQ ID NO: 306059 - DNA, 20 bp, Artificial Sequence
  Description of Artificial Sequence: Synthetic oligonucleotide
  Target: ATXN1; (+) strand; PAM type: YTN; PAM sequence: TTA
gctgggcgtggtggcgtgtg

SEQ ID NO: 306060 - DNA, 20 bp, Artificial Sequence
  Description of Artificial Sequence: Synthetic oligonucleotide
  Target: ATXN1; (+) strand; PAM type: YTN; PAM sequence: CTG
ggcgtggtggcgtgtgcctg

SEQ ID NO: 306061 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacacaggtg

SEQ ID NO: 306062 - DNA, 20 bp, Artificial Sequence
  Description of Artificial Sequence: Synthetic oligonucleotide
  Target: ATXN1; (+) strand; PAM type: YTN; PAM sequence: CTA
cacaggtggctgaggcaaga

SEQ ID NO: 306063 - DNA, 20 bp, Artificial Sequence
  Description of Artificial Sequence: Synthetic oligonucleotide
  Target: ATXN1; (+) strand; PAM type: YTN; PAM sequence: CTG
aggcaagagaatcgctggaa

SEQ ID NO: 306064 - DNA, 20 bp, Artificial Sequence
  Description of Artificial Sequence: Synthetic oligonucleotide
  Target: ATXN1; (+) strand; PAM type: YTN; PAM sequence: CTG
gaacccgggggagcagaggc

SEQ ID NO: 306065 - DNA, 20 bp, Artificial Sequence
  Description of Artificial Sequence: Synthetic oligonucleotide
  Target: ATXN1; (+) strand; PAM type: YTN; PAM sequence: CTG
cagtgagtcaagattgcatc

SEQ ID NO: 306066 - DNA, 20 bp, Artificial Sequence
  Description of Artificial Sequence: Synthetic oligonucleotide
  Target: ATXN1; (+) strand; PAM type: YTN; PAM sequence: TTG
catcactgcactccagtctg

SEQ ID NO: 306067 - DNA, 20 bp, Artificial Sequence
  Description of Artificial Sequence: Synthetic oligonucleotide
  Target: ATXN1; (+) strand; PAM type: YTN; PAM sequence: CTG
cactccagtctgggtggcag

SEQ ID NO: 306068 - DNA, 20 bp, Artificial Sequence
  Description of Artificial Sequence: Synthetic oligonucleotide
  Target: ATXN1; (+) strand; PAM type: YTN; PAM sequence: CTC
cagtctgggtggcagagcaa

SEQ ID NO: 306069 - DNA, 20 bp, Artificial Sequence
  Description of Artificial Sequence: Synthetic oligonucleotide
  Target: ATXN1; (+) strand; PAM type: YTN; PAM sequence: CTG
ggtggcagagcaagactctg

SEQ ID NO: 306070 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 306071 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaaa

SEQ ID NO: 306072 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaggg

SEQ ID NO: 306073 - DNA, 20 bp, Artificial Sequence
  Description of Artificial Sequence: Synthetic oligonucleotide
  Target: ATXN1; (+) strand; PAM type: YTN; PAM sequence: TTC
ccagttctgcccactaacat

SEQ ID NO: 306074 - DNA, 20 bp, Artificial Sequence
  Description of Artificial Sequence: Synthetic oligonucleotide
  Target: ATXN1; (+) strand; PAM type: YTN; PAM sequence: TTC
tgcccactaacattaagaga

SEQ ID NO: 306075 - DNA, 20 bp, Artificial Sequence
  Description of Artificial Sequence: Synthetic oligonucleotide
  Target: ATXN1; (+) strand; PAM type: YTN; PAM sequence: CTG
cccactaacattaagagatt

SEQ ID NO: 306076 - DNA, 20 bp, Artificial Sequence
  Description of Artificial Sequence: Synthetic oligonucleotide
  Target: ATXN1; (+) strand; PAM type: YTN; PAM sequence: CTA
acattaagagattttcatat

SEQ ID NO: 306077 - DNA, 20 bp, Artificial Sequence
  Description of Artificial Sequence: Synthetic oligonucleotide
  Target: ATXN1; (+) strand; PAM type: YTN; PAM sequence: TTA
agagattttcatatgtataa

SEQ ID NO: 306078 - DNA, 20 bp, Artificial Sequence
  Description of Artificial Sequence: Synthetic oligonucleotide
  Target: ATXN1; (+) strand; PAM type: YTN; PAM sequence: TTT
tcatatgtataatatcttag

SEQ ID NO: 306079 - DNA, 20 bp, Artificial Sequence
  Description of Artificial Sequence: Synthetic oligonucleotide
  Target: ATXN1; (+) strand; PAM type: YTN; PAM sequence: TTT
catatgtataatatcttagt

SEQ ID NO: 306080 - DNA, 20 bp, Artificial Sequence
  Description of Artificial Sequence: Synthetic oligonucleotide
  Target: ATXN1; (+) strand; PAM type: YTN; PAM sequence: TTC
atatgtataatatcttagtg

SEQ ID NO: 306081 - DNA, 20 bp, Artificial Sequence
  Description of Artificial Sequence: Synthetic oligonucleotide
  Target: ATXN1; (+) strand; PAM type: YTN; PAM sequence: CTT
agtgtcactgctaaactaaa

SEQ ID NO: 306082 - DNA, 20 bp, Artificial Sequence
  Description of Artificial Sequence: Synthetic oligonucleotide
  Target: ATXN1; (+) strand; PAM type: YTN; PAM sequence: TTA
gtgtcactgctaaactaaaa

SEQ ID NO: 306083 - DNA, 20 bp, Artificial Sequence
  Description of Artificial Sequence: Synthetic oligonucleotide
  Target: ATXN1; (+) strand; PAM type: YTN; PAM sequence: CTG
ctaaactaaaacactaaggt

SEQ ID NO: 306084 - DNA, 20 bp, Artificial Sequence
  Description of Artificial Sequence: Synthetic oligonucleotide
  Target: ATXN1; (+) strand; PAM type: YTN; PAM sequence: CTA
aactaaaacactaaggtaga

SEQ ID NO: 306085 - DNA, 20 bp, Artificial Sequence
  Description of Artificial Sequence: Synthetic oligonucleotide
  Target: ATXN1; (+) strand; PAM type: YTN; PAM sequence: CTA
aaacactaaggtagaacttc

SEQ ID NO: 306086 - DNA, 20 bp, Artificial Sequence
  Description of Artificial Sequence: Synthetic oligonucleotide
  Target: ATXN1; (+) strand; PAM type: YTN; PAM sequence: CTA
aggtagaacttctcttcgta

SEQ ID NO: 306087 - DNA, 20 bp, Artificial Sequence
  Description of Artificial Sequence: Synthetic oligonucleotide
  Target: ATXN1; (+) strand; PAM type: YTN; PAM sequence: CTT
ctcttcgtagatgataccaa

SEQ ID NO: 306088 - DNA, 20 bp, Artificial Sequence
  Description of Artificial Sequence: Synthetic oligonucleotide
  Target: ATXN1; (+) strand; PAM type: YTN; PAM sequence: TTC
tcttcgtagatgataccaat

SEQ ID NO: 306089 - DNA, 20 bp, Artificial Sequence
  Description of Artificial Sequence: Synthetic oligonucleotide
  Target: ATXN1; (+) strand; PAM type: YTN; PAM sequence: CTC
ttcgtagatgataccaatta

SEQ ID NO: 306090 - DNA, 20 bp, Artificial Sequence
  Description of Artificial Sequence: Synthetic oligonucleotide
  Target: ATXN1; (+) strand; PAM type: YTN; PAM sequence: CTT
cgtagatgataccaattatc

SEQ ID NO: 306091 - DNA, 20 bp, Artificial Sequence
  Description of Artificial Sequence: Synthetic oligonucleotide
  Target: ATXN1; (+) strand; PAM type: YTN; PAM sequence: TTC
gtagatgataccaattatca

SEQ ID NO: 306092 - DNA, 20 bp, Artificial Sequence
  Description of Artificial Sequence: Synthetic oligonucleotide
  Target: ATXN1; (+) strand; PAM type: YTN; PAM sequence: TTA
tcattttaaaatgcaaatta

SEQ ID NO: 306093 - DNA, 20 bp, Artificial Sequence
  Description of Artificial Sequence: Synthetic oligonucleotide
  Target: ATXN1; (+) strand; PAM type: YTN; PAM sequence: TTT
taaaatgcaaattactaaga

SEQ ID NO: 306094 - DNA, 20 bp, Artificial Sequence
  Description of Artificial Sequence: Synthetic oligonucleotide
  Target: ATXN1; (+) strand; PAM type: YTN; PAM sequence: TTT
aaaatgcaaattactaagac

SEQ ID NO: 306095 - DNA, 20 bp, Artificial Sequence
  Description of Artificial Sequence: Synthetic oligonucleotide
  Target: ATXN1; (+) strand; PAM type: YTN; PAM sequence: TTA
aaatgcaaattactaagacc

SEQ ID NO: 306096 - DNA, 20 bp, Artificial Sequence
  Description of Artificial Sequence: Synthetic oligonucleotide
  Target: ATXN1; (+) strand; PAM type: YTN; PAM sequence: TTA
ctaagacctcttgcacccaa

SEQ ID NO: 306097 - DNA, 20 bp, Artificial Sequence
  Description of Artificial Sequence: Synthetic oligonucleotide
  Target: ATXN1; (+) strand; PAM type: YTN; PAM sequence: CTA
agacctcttgcacccaatta

SEQ ID NO: 306098 - DNA, 20 bp, Artificial Sequence
  Description of Artificial Sequence: Synthetic oligonucleotide
  Target: ATXN1; (+) strand; PAM type: YTN; PAM sequence: CTC
ttgcacccaattatgtatga

SEQ ID NO: 306099 - DNA, 20 bp, Artificial Sequence
  Description of Artificial Sequence: Synthetic oligonucleotide
  Target: ATXN1; (+) strand; PAM type: YTN; PAM sequence: CTT
gcacccaattatgtatgaca

SEQ ID NO: 306100 - DNA, 20 bp, Artificial Sequence
  Description of Artificial Sequence: Synthetic oligonucleotide
  Target: ATXN1; (+) strand; PAM type: YTN; PAM sequence: TTG
cacccaattatgtatgacat

SEQ ID NO: 306101 - DNA, 20 bp, Artificial Sequence
  Description of Artificial Sequence: Synthetic oligonucleotide
  Target: ATXN1; (+) strand; PAM type: YTN; PAM sequence: TTA
tgtatgacatagaataattt

SEQ ID NO: 306102 - DNA, 20 bp, Artificial Sequence
  Description of Artificial Sequence: Synthetic oligonucleotide
  Target: ATXN1; (+) strand; PAM type: YTN; PAM sequence: TTT
cttggccgggcccggtagct

SEQ ID NO: 306103 - DNA, 20 bp, Artificial Sequence
  Description of Artificial Sequence: Synthetic oligonucleotide
  Target: ATXN1; (+) strand; PAM type: YTN; PAM sequence: TTC
ttggccgggcccggtagctc

SEQ ID NO: 306104 - DNA, 20 bp, Artificial Sequence
  Description of Artificial Sequence: Synthetic oligonucleotide
  Target: ATXN1; (+) strand; PAM type: YTN; PAM sequence: CTT
ggccgggcccggtagctcac

SEQ ID NO: 306105 - DNA, 20 bp, Artificial Sequence
  Description of Artificial Sequence: Synthetic oligonucleotide
  Target: ATXN1; (+) strand; PAM type: YTN; PAM sequence: TTG
gccgggcccggtagctcaca

SEQ ID NO: 306106 - DNA, 20 bp, Artificial Sequence
  Description of Artificial Sequence: Synthetic oligonucleotide
  Target: ATXN1; (+) strand; PAM type: YTN; PAM sequence: CTC
acacctatagtcccagcact

SEQ ID NO: 306107 - DNA, 20 bp, Artificial Sequence
  Description of Artificial Sequence: Synthetic oligonucleotide
  Target: ATXN1; (+) strand; PAM type: YTN; PAM sequence: CTA
tagtcccagcactttgggag

SEQ ID NO: 306108 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggtgg

SEQ ID NO: 306109 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggtgga

SEQ ID NO: 306110 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggtggat

SEQ ID NO: 306111 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagttcaagact

SEQ ID NO: 306112 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcaagacta

SEQ ID NO: 306113 - DNA, 20 bp, Artificial Sequence
  Description of Artificial Sequence: Synthetic oligonucleotide
  Target: ATXN1; (+) strand; PAM type: YTN; PAM sequence: TTC
aagactagcctggccaacac

SEQ ID NO: 306114 - DNA, 20 bp, Artificial Sequence
  Description of Artificial Sequence: Synthetic oligonucleotide
  Target: ATXN1; (+) strand; PAM type: YTN; PAM sequence: CTA
gcctggccaacacggtgaaa

SEQ ID NO: 306115 - DNA, 20 bp, Artificial Sequence
  Description of Artificial Sequence: Synthetic oligonucleotide
  Target: ATXN1; (+) strand; PAM type: YTN; PAM sequence: CTG
gccaacacggtgaaactcca

SEQ ID NO: 306116 - DNA, 20 bp, Artificial Sequence
  Description of Artificial Sequence: Synthetic oligonucleotide
  Target: ATXN1; (+) strand; PAM type: YTN; PAM sequence: CTC
catctctactaaaaagacaa

SEQ ID NO: 306117 - DNA, 20 bp, Artificial Sequence
  Description of Artificial Sequence: Synthetic oligonucleotide
  Target: ATXN1; (+) strand; PAM type: YTN; PAM sequence: CTC
tactaaaaagacaaaaaaca

SEQ ID NO: 306118 - DNA, 20 bp, Artificial Sequence
  Description of Artificial Sequence: Synthetic oligonucleotide
  Target: ATXN1; (+) strand; PAM type: YTN; PAM sequence: CTA
ctaaaaagacaaaaaacagc

SEQ ID NO: 306119 - DNA, 20 bp, Artificial Sequence
  Description of Artificial Sequence: Synthetic oligonucleotide
  Target: ATXN1; (+) strand; PAM type: YTN; PAM sequence: CTA
aaaagacaaaaaacagctgg

SEQ ID NO: 306120 - DNA, 20 bp, Artificial Sequence
  Description of Artificial Sequence: Synthetic oligonucleotide
  Target: ATXN1; (+) strand; PAM type: YTN; PAM sequence: CTG
ggtgcctgtaatcccagcta

SEQ ID NO: 306121 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactctactc

SEQ ID NO: 306122 - DNA, 20 bp, Artificial Sequence
  Description of Artificial Sequence: Synthetic oligonucleotide
  Target: ATXN1; (+) strand; PAM type: YTN; PAM sequence: CTA
ctctactcaggaggctgagg

SEQ ID NO: 306123 - DNA, 20 bp, Artificial Sequence
  Description of Artificial Sequence: Synthetic oligonucleotide
  Target: ATXN1; (+) strand; PAM type: YTN; PAM sequence: CTC
tactcaggaggctgaggcag

SEQ ID NO: 306124 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagaa

SEQ ID NO: 306125 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcagaagaa

SEQ ID NO: 306126 - DNA, 20 bp, Artificial Sequence
  Description of Artificial Sequence: Synthetic oligonucleotide
  Target: ATXN1; (+) strand; PAM type: YTN; PAM sequence: CTG
aggcagaagaatcgcttgaa

SEQ ID NO: 306127 - DNA, 20 bp, Artificial Sequence
  Description of Artificial Sequence: Synthetic oligonucleotide
  Target: ATXN1; (+) strand; PAM type: YTN; PAM sequence: CTT
gaagccgggaggtggaggtt

SEQ ID NO: 306128 - DNA, 20 bp, Artificial Sequence
  Description of Artificial Sequence: Synthetic oligonucleotide
  Target: ATXN1; (+) strand; PAM type: YTN; PAM sequence: TTG
aagccgggaggtggaggttg

SEQ ID NO: 306129 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcatgcc

SEQ ID NO: 306130 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggcgacaa

SEQ ID NO: 306131 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacaagagcg

SEQ ID NO: 306132 - DNA, 20 bp, Artificial Sequence
  Description of Artificial Sequence: Synthetic oligonucleotide
  Target: ATXN1; (+) strand; PAM type: YTN; PAM sequence: CTG
ggcgacaagagcgaaacttc

SEQ ID NO: 306133 - DNA, 20 bp, Artificial Sequence
  Description of Artificial Sequence: Synthetic oligonucleotide
  Target: ATXN1; (+) strand; PAM type: YTN; PAM sequence: CTT
catctcaaaaaaaaacaaag

SEQ ID NO: 306134 - DNA, 20 bp, Artificial Sequence
  Description of Artificial Sequence: Synthetic oligonucleotide
  Target: ATXN1; (+) strand; PAM type: YTN; PAM sequence: TTC
atctcaaaaaaaaacaaaga

SEQ ID NO: 306135 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaacaaagaataat

SEQ ID NO: 306136 - DNA, 20 bp, Artificial Sequence
  Description of Artificial Sequence: Synthetic oligonucleotide
  Target: ATXN1; (+) strand; PAM type: YTN; PAM sequence: TTT
cttaacagggtcctacttca

SEQ ID NO: 306137 - DNA, 20 bp, Artificial Sequence
  Description of Artificial Sequence: Synthetic oligonucleotide
  Target: ATXN1; (+) strand; PAM type: YTN; PAM sequence: TTC
ttaacagggtcctacttcag

SEQ ID NO: 306138 - DNA, 20 bp, Artificial Sequence
  Description of Artificial Sequence: Synthetic oligonucleotide
  Target: ATXN1; (+) strand; PAM type: YTN; PAM sequence: CTT
aacagggtcctacttcagat

SEQ ID NO: 306139 - DNA, 20 bp, Artificial Sequence
  Description of Artificial Sequence: Synthetic oligonucleotide
  Target: ATXN1; (+) strand; PAM type: YTN; PAM sequence: TTA
acagggtcctacttcagatg

SEQ ID NO: 306140 - DNA, 20 bp, Artificial Sequence
  Description of Artificial Sequence: Synthetic oligonucleotide
  Target: ATXN1; (+) strand; PAM type: YTN; PAM sequence: CTA
cttcagatggattgctcaag

SEQ ID NO: 306141 - DNA, 20 bp, Artificial Sequence
  Description of Artificial Sequence: Synthetic oligonucleotide
  Target: ATXN1; (+) strand; PAM type: YTN; PAM sequence: CTT
cagatggattgctcaagagt

SEQ ID NO: 306142 - DNA, 20 bp, Artificial Sequence
  Description of Artificial Sequence: Synthetic oligonucleotide
  Target: ATXN1; (+) strand; PAM type: YTN; PAM sequence: TTC
agatggattgctcaagagtt

SEQ ID NO: 306143 - DNA, 20 bp, Artificial Sequence
  Description of Artificial Sequence: Synthetic oligonucleotide
  Target: ATXN1; (+) strand; PAM type: YTN; PAM sequence: TTG
ctcaagagttcaggccatat

SEQ ID NO: 306144 - DNA, 20 bp, Artificial Sequence
  Description of Artificial Sequence: Synthetic oligonucleotide
  Target: ATXN1; (+) strand; PAM type: YTN; PAM sequence: CTC
aagagttcaggccatatgga

SEQ ID NO: 306145 - DNA, 20 bp, Artificial Sequence
  Description of Artificial Sequence: Synthetic oligonucleotide
  Target: ATXN1; (+) strand; PAM type: YTN; PAM sequence: TTC
aggccatatggagtacaatt

SEQ ID NO: 306146 - DNA, 20 bp, Artificial Sequence
  Description of Artificial Sequence: Synthetic oligonucleotide
  Target: ATXN1; (+) strand; PAM type: YTN; PAM sequence: TTA
gacactgaacatactacttt

SEQ ID NO: 306147 - DNA, 20 bp, Artificial Sequence
  Description of Artificial Sequence: Synthetic oligonucleotide
  Target: ATXN1; (+) strand; PAM type: YTN; PAM sequence: CTG
aacatactactttctggatc

SEQ ID NO: 306148 - DNA, 20 bp, Artificial Sequence
  Description of Artificial Sequence: Synthetic oligonucleotide
  Target: ATXN1; (+) strand; PAM type: YTN; PAM sequence: CTA
ctttctggatctgggccagt

SEQ ID NO: 306149 - DNA, 20 bp, Artificial Sequence
  Description of Artificial Sequence: Synthetic oligonucleotide
  Target: ATXN1; (+) strand; PAM type: YTN; PAM sequence: CTT
tctggatctgggccagtatg

SEQ ID NO: 306150 - DNA, 20 bp, Artificial Sequence
  Description of Artificial Sequence: Synthetic oligonucleotide
  Target: ATXN1; (+) strand; PAM type: YTN; PAM sequence: TTT
ctggatctgggccagtatga

SEQ ID NO: 306151 - DNA, 20 bp, Artificial Sequence
  Description of Artificial Sequence: Synthetic oligonucleotide
  Target: ATXN1; (+) strand; PAM type: YTN; PAM sequence: TTC
tggatctgggccagtatgac

SEQ ID NO: 306152 - DNA, 20 bp, Artificial Sequence
  Description of Artificial Sequence: Synthetic oligonucleotide
  Target: ATXN1; (+) strand; PAM type: YTN; PAM sequence: CTG
gatctgggccagtatgacaa

SEQ ID NO: 306153 - DNA, 20 bp, Artificial Sequence
  Description of Artificial Sequence: Synthetic oligonucleotide
  Target: ATXN1; (+) strand; PAM type: YTN; PAM sequence: CTG
ggccagtatgacaaatatta

SEQ ID NO: 306154 - DNA, 20 bp, Artificial Sequence
  Description of Artificial Sequence: Synthetic oligonucleotide
  Target: ATXN1; (+) strand; PAM type: YTN; PAM sequence: TTA
caaaagctattttttccaga

SEQ ID NO: 306155 - DNA, 20 bp, Artificial Sequence
  Description of Artificial Sequence: Synthetic oligonucleotide
  Target: ATXN1; (+) strand; PAM type: YTN; PAM sequence: CTA
ttttttccagaaagtcatca

SEQ ID NO: 306156 - DNA, 20 bp, Artificial Sequence
  Description of Artificial Sequence: Synthetic oligonucleotide
  Target: ATXN1; (+) strand; PAM type: YTN; PAM sequence: TTT
tttccagaaagtcatcacag

SEQ ID NO: 306157 - DNA, 20 bp, Artificial Sequence
  Description of Artificial Sequence: Synthetic oligonucleotide
  Target: ATXN1; (+) strand; PAM type: YTN; PAM sequence: TTT
ttccagaaagtcatcacagt

SEQ ID NO: 306158 - DNA, 20 bp, Artificial Sequence
  Description of Artificial Sequence: Synthetic oligonucleotide
  Target: ATXN1; (+) strand; PAM type: YTN; PAM sequence: TTT
tccagaaagtcatcacagtt

SEQ ID NO: 306159 - DNA, 20 bp, Artificial Sequence
  Description of Artificial Sequence: Synthetic oligonucleotide
  Target: ATXN1; (+) strand; PAM type: YTN; PAM sequence: TTT
ccagaaagtcatcacagttt

SEQ ID NO: 306160 - DNA, 20 bp, Artificial Sequence
  Description of Artificial Sequence: Synthetic oligonucleotide
  Target: ATXN1; (+) strand; PAM type: YTN; PAM sequence: TTC
cagaaagtcatcacagtttg

SEQ ID NO: 306161 - DNA, 20 bp, Artificial Sequence
  Description of Artificial Sequence: Synthetic oligonucleotide
  Target: ATXN1; (+) strand; PAM type: YTN; PAM sequence: TTT
gaaacagacagtgacttatt

SEQ ID NO: 306162 - DNA, 20 bp, Artificial Sequence
  Description of Artificial Sequence: Synthetic oligonucleotide
  Target: ATXN1; (+) strand; PAM type: YTN; PAM sequence: TTG
aaacagacagtgacttatta

SEQ ID NO: 306163 - DNA, 20 bp, Artificial Sequence
  Description of Artificial Sequence: Synthetic oligonucleotide
  Target: ATXN1; (+) strand; PAM type: YTN; PAM sequence: CTT
attaccctaaagccttttca

SEQ ID NO: 306164 - DNA, 20 bp, Artificial Sequence
  Description of Artificial Sequence: Synthetic oligonucleotide
  Target: ATXN1; (+) strand; PAM type: YTN; PAM sequence: TTA
ttaccctaaagccttttcaa

SEQ ID NO: 306165 - DNA, 20 bp, Artificial Sequence
  Description of Artificial Sequence: Synthetic oligonucleotide
  Target: ATXN1; (+) strand; PAM type: YTN; PAM sequence: TTA
ccctaaagccttttcaatta

SEQ ID NO: 306166 - DNA, 20 bp, Artificial Sequence
  Description of Artificial Sequence: Synthetic oligonucleotide
  Target: ATXN1; (+) strand; PAM type: YTN; PAM sequence: CTA
aagccttttcaattatgaag

SEQ ID NO: 306167 - DNA, 20 bp, Artificial Sequence
  Description of Artificial Sequence: Synthetic oligonucleotide
  Target: ATXN1; (+) strand; PAM type: YTN; PAM sequence: CTT
ttcaattatgaagtgcctgc

SEQ ID NO: 306168 - DNA, 20 bp, Artificial Sequence
  Description of Artificial Sequence: Synthetic oligonucleotide
  Target: ATXN1; (+) strand; PAM type: YTN; PAM sequence: TTT
tcaattatgaagtgcctgct

SEQ ID NO: 306169 - DNA, 20 bp, Artificial Sequence
  Description of Artificial Sequence: Synthetic oligonucleotide
  Target: ATXN1; (+) strand; PAM type: YTN; PAM sequence: TTT
caattatgaagtgcctgctc

SEQ ID NO: 306170 - DNA, 20 bp, Artificial Sequence
  Description of Artificial Sequence: Synthetic oligonucleotide
  Target: ATXN1; (+) strand; PAM type: YTN; PAM sequence: TTC
aattatgaagtgcctgctct

SEQ ID NO: 306171 - DNA, 20 bp, Artificial Sequence
  Description of Artificial Sequence: Synthetic oligonucleotide
  Target: ATXN1; (+) strand; PAM type: YTN; PAM sequence: TTA
tgaagtgcctgctctggtgt

SEQ ID NO: 306172 - DNA, 20 bp, Artificial Sequence
  Description of Artificial Sequence: Synthetic oligonucleotide
  Target: ATXN1; (+) strand; PAM type: YTN; PAM sequence: CTG
ctctggtgttactacatata

SEQ ID NO: 306173 - DNA, 20 bp, Artificial Sequence
  Description of Artificial Sequence: Synthetic oligonucleotide
  Target: ATXN1; (+) strand; PAM type: YTN; PAM sequence: CTC
tggtgttactacatatacaa

SEQ ID NO: 306174 - DNA, 20 bp, Artificial Sequence
  Description of Artificial Sequence: Synthetic oligonucleotide
  Target: ATXN1; (+) strand; PAM type: YTN; PAM sequence: CTG
gtgttactacatatacaaag

SEQ ID NO: 306175 - DNA, 20 bp, Artificial Sequence
  Description of Artificial Sequence: Synthetic oligonucleotide
  Target: ATXN1; (+) strand; PAM type: YTN; PAM sequence: TTA
ctacatatacaaaggtggtt

SEQ ID NO: 306176 - DNA, 20 bp, Artificial Sequence
  Description of Artificial Sequence: Synthetic oligonucleotide
  Target: ATXN1; (+) strand; PAM type: YTN; PAM sequence: CTA
catatacaaaggtggttaca

SEQ ID NO: 306177 - DNA, 20 bp, Artificial Sequence
  Description of Artificial Sequence: Synthetic oligonucleotide
  Target: ATXN1; (+) strand; PAM type: YTN; PAM sequence: TTA
caaacataaataagtaacca

SEQ ID NO: 306178 - DNA, 20 bp, Artificial Sequence
  Description of Artificial Sequence: Synthetic oligonucleotide
  Target: ATXN1; (+) strand; PAM type: YTN; PAM sequence: CTG
ttttctctttctctcctcta

SEQ ID NO: 306179 - DNA, 20 bp, Artificial Sequence
  Description of Artificial Sequence: Synthetic oligonucleotide
  Target: ATXN1; (+) strand; PAM type: YTN; PAM sequence: TTT
tctctttctctcctctagta

SEQ ID NO: 306180 - DNA, 20 bp, Artificial Sequence
  Description of Artificial Sequence: Synthetic oligonucleotide
  Target: ATXN1; (+) strand; PAM type: YTN; PAM sequence: TTT
ctctttctctcctctagtaa

SEQ ID NO: 306181 - DNA, 20 bp, Artificial Sequence
  Description of Artificial Sequence: Synthetic oligonucleotide
  Target: ATXN1; (+) strand; PAM type: YTN; PAM sequence: TTC
tctttctctcctctagtaaa

SEQ ID NO: 306182 - DNA, 20 bp, Artificial Sequence
  Description of Artificial Sequence: Synthetic oligonucleotide
  Target: ATXN1; (+) strand; PAM type: YTN; PAM sequence: CTC
tttctctcctctagtaaatt

SEQ ID NO: 306183 - DNA, 20 bp, Artificial Sequence
  Description of Artificial Sequence: Synthetic oligonucleotide
  Target: ATXN1; (+) strand; PAM type: YTN; PAM sequence: CTT
tctctcctctagtaaattat

SEQ ID NO: 306184 - DNA, 20 bp, Artificial Sequence
  Description of Artificial Sequence: Synthetic oligonucleotide
  Target: ATXN1; (+) strand; PAM type: YTN; PAM sequence: TTT
ctctcctctagtaaattatg

SEQ ID NO: 306185 - DNA, 20 bp, Artificial Sequence
  Description of Artificial Sequence: Synthetic oligonucleotide
  Target: ATXN1; (+) strand; PAM type: YTN; PAM sequence: TTC
tctcctctagtaaattatgt

SEQ ID NO: 306186 - DNA, 20 bp, Artificial Sequence
  Description of Artificial Sequence: Synthetic oligonucleotide
  Target: ATXN1; (+) strand; PAM type: YTN; PAM sequence: CTC
tcctctagtaaattatgtta

SEQ ID NO: 306187 - DNA, 20 bp, Artificial Sequence
  Description of Artificial Sequence: Synthetic oligonucleotide
  Target: ATXN1; (+) strand; PAM type: YTN; PAM sequence: CTC
ctctagtaaattatgttaat

SEQ ID NO: 306188 - DNA, 20 bp, Artificial Sequence
  Description of Artificial Sequence: Synthetic oligonucleotide
  Target: ATXN1; (+) strand; PAM type: YTN; PAM sequence: CTC
tagtaaattatgttaattaa

SEQ ID NO: 306189 - DNA, 20 bp, Artificial Sequence
  Description of Artificial Sequence: Synthetic oligonucleotide
  Target: ATXN1; (+) strand; PAM type: YTN; PAM sequence: CTA
gtaaattatgttaattaagc

SEQ ID NO: 306190 - DNA, 20 bp, Artificial Sequence
  Description of Artificial Sequence: Synthetic oligonucleotide
  Target: ATXN1; (+) strand; PAM type: YTN; PAM sequence: TTA
tgttaattaagcaaattaag

SEQ ID NO: 306191 - DNA, 20 bp, Artificial Sequence
  Description of Artificial Sequence: Synthetic oligonucleotide
  Target: ATXN1; (+) strand; PAM type: YTN; PAM sequence: TTA
attaagcaaattaagatgat

SEQ ID NO: 306192 - DNA, 20 bp, Artificial Sequence
  Description of Artificial Sequence: Synthetic oligonucleotide
  Target: ATXN1; (+) strand; PAM type: YTN; PAM sequence: TTA
agcaaattaagatgattaaa

SEQ ID NO: 306193 - DNA, 20 bp, Artificial Sequence
  Description of Artificial Sequence: Synthetic oligonucleotide
  Target: ATXN1; (+) strand; PAM type: YTN; PAM sequence: TTA
agatgattaaagttcaaaat

SEQ ID NO: 306194 - DNA, 20 bp, Artificial Sequence
  Description of Artificial Sequence: Synthetic oligonucleotide
  Target: ATXN1; (+) strand; PAM type: YTN; PAM sequence: TTA
aagttcaaaatctttcataa

SEQ ID NO: 306195 - DNA, 20 bp, Artificial Sequence
  Description of Artificial Sequence: Synthetic oligonucleotide
  Target: ATXN1; (+) strand; PAM type: YTN; PAM sequence: TTC
aaaatctttcataattgttt

SEQ ID NO: 306196 - DNA, 20 bp, Artificial Sequence
  Description of Artificial Sequence: Synthetic oligonucleotide
  Target: ATXN1; (+) strand; PAM type: YTN; PAM sequence: CTT
tcataattgtttacaatttt

SEQ ID NO: 306197 - DNA, 20 bp, Artificial Sequence
  Description of Artificial Sequence: Synthetic oligonucleotide
  Target: ATXN1; (+) strand; PAM type: YTN; PAM sequence: TTT
cataattgtttacaattttc

SEQ ID NO: 306198 - DNA, 20 bp, Artificial Sequence
  Description of Artificial Sequence: Synthetic oligonucleotide
  Target: ATXN1; (+) strand; PAM type: YTN; PAM sequence: TTC
ataattgtttacaattttca

SEQ ID NO: 306199 - DNA, 20 bp, Artificial Sequence
  Description of Artificial Sequence: Synthetic oligonucleotide
  Target: ATXN1; (+) strand; PAM type: YTN; PAM sequence: TTG
tttacaattttcaagtatca

SEQ ID NO: 306200 - DNA, 20 bp, Artificial Sequence
  Description of Artificial Sequence: Synthetic oligonucleotide
  Target: ATXN1; (+) strand; PAM type: YTN; PAM sequence: TTT
acaattttcaagtatcagta

SEQ ID NO: 306201 - DNA, 20 bp, Artificial Sequence
  Description of Artificial Sequence: Synthetic oligonucleotide
  Target: ATXN1; (+) strand; PAM type: YTN; PAM sequence: TTA
caattttcaagtatcagtaa

SEQ ID NO: 306202 - DNA, 20 bp, Artificial Sequence
  Description of Artificial Sequence: Synthetic oligonucleotide
  Target: ATXN1; (+) strand; PAM type: YTN; PAM sequence: TTT
tcaagtatcagtaaaaccac

SEQ ID NO: 306203 - DNA, 20 bp, Artificial Sequence
  Description of Artificial Sequence: Synthetic oligonucleotide
  Target: ATXN1; (+) strand; PAM type: YTN; PAM sequence: TTT
caagtatcagtaaaaccaca

SEQ ID NO: 306204 - DNA, 20 bp, Artificial Sequence
  Description of Artificial Sequence: Synthetic oligonucleotide
  Target: ATXN1; (+) strand; PAM type: YTN; PAM sequence: TTC
aagtatcagtaaaaccacaa

SEQ ID NO: 306205 - DNA, 20 bp, Artificial Sequence
  Description of Artificial Sequence: Synthetic oligonucleotide
  Target: ATXN1; (+) strand; PAM type: YTN; PAM sequence: TTA
aatataataaaaaagcaatt

SEQ ID NO: 306206 - DNA, 20 bp, Artificial Sequence
  Description of Artificial Sequence: Synthetic oligonucleotide
  Target: ATXN1; (+) strand; PAM type: YTN; PAM sequence: TTA
attttggatccatatatact

SEQ ID NO: 306207 - DNA, 20 bp, Artificial Sequence
  Description of Artificial Sequence: Synthetic oligonucleotide
  Target: ATXN1; (+) strand; PAM type: YTN; PAM sequence: TTT
tggatccatatatactagta

SEQ ID NO: 306208 - DNA, 20 bp, Artificial Sequence
  Description of Artificial Sequence: Synthetic oligonucleotide
  Target: ATXN1; (+) strand; PAM type: YTN; PAM sequence: TTT
ggatccatatatactagtag

SEQ ID NO: 306209 - DNA, 20 bp, Artificial Sequence
  Description of Artificial Sequence: Synthetic oligonucleotide
  Target: ATXN1; (+) strand; PAM type: YTN; PAM sequence: TTG
gatccatatatactagtagg

SEQ ID NO: 306210 - DNA, 20 bp, Artificial Sequence
  Description of Artificial Sequence: Synthetic oligonucleotide
  Target: ATXN1; (+) strand; PAM type: YTN; PAM sequence: CTA
gtaggtaagagaaaaaatgg

SEQ ID NO: 306211 - DNA, 20 bp, Artificial Sequence
  Description of Artificial Sequence: Synthetic oligonucleotide
  Target: ATXN1; (+) strand; PAM type: YTN; PAM sequence: TTC
caaagtgaggtttgatgctg

SEQ ID NO: 306212 - DNA, 20 bp, Artificial Sequence
  Description of Artificial Sequence: Synthetic oligonucleotide
  Target: ATXN1; (+) strand; PAM type: YTN; PAM sequence: TTT
gatgctgaaaatttgaacca

SEQ ID NO: 306213 - DNA, 20 bp, Artificial Sequence
  Description of Artificial Sequence: Synthetic oligonucleotide
  Target: ATXN1; (+) strand; PAM type: YTN; PAM sequence: TTG
atgctgaaaatttgaaccac

SEQ ID NO: 306214 - DNA, 20 bp, Artificial Sequence
  Description of Artificial Sequence: Synthetic oligonucleotide
  Target: ATXN1; (+) strand; PAM type: YTN; PAM sequence: CTG
aaaatttgaaccaccgtctc

SEQ ID NO: 306215 - DNA, 20 bp, Artificial Sequence
  Description of Artificial Sequence: Synthetic oligonucleotide
  Target: ATXN1; (+) strand; PAM type: YTN; PAM sequence: TTT
gaaccaccgtctctgtcaat

SEQ ID NO: 306216 - DNA, 20 bp, Artificial Sequence
  Description of Artificial Sequence: Synthetic oligonucleotide
  Target: ATXN1; (+) strand; PAM type: YTN; PAM sequence: TTG
aaccaccgtctctgtcaatt

SEQ ID NO: 306217 - DNA, 20 bp, Artificial Sequence
  Description of Artificial Sequence: Synthetic oligonucleotide
  Target: ATXN1; (+) strand; PAM type: YTN; PAM sequence: CTC
tgtcaattattgtaacacac

SEQ ID NO: 306218 - DNA, 20 bp, Artificial Sequence
  Description of Artificial Sequence: Synthetic oligonucleotide
  Target: ATXN1; (+) strand; PAM type: YTN; PAM sequence: CTG
tcaattattgtaacacacaa

SEQ ID NO: 306219 - DNA, 20 bp, Artificial Sequence
  Description of Artificial Sequence: Synthetic oligonucleotide
  Target: ATXN1; (+) strand; PAM type: YTN; PAM sequence: TTA
ttgtaacacacaaaaaagtt

SEQ ID NO: 306220 - DNA, 20 bp, Artificial Sequence
  Description of Artificial Sequence: Synthetic oligonucleotide
  Target: ATXN1; (+) strand; PAM type: YTN; PAM sequence: TTG
taacacacaaaaaagttact

SEQ ID NO: 306221 - DNA, 20 bp, Artificial Sequence
  Description of Artificial Sequence: Synthetic oligonucleotide
  Target: ATXN1; (+) strand; PAM type: YTN; PAM sequence: TTA
ctacatactcagtaactggg

SEQ ID NO: 306222 - DNA, 20 bp, Artificial Sequence
  Description of Artificial Sequence: Synthetic oligonucleotide
  Target: ATXN1; (+) strand; PAM type: YTN; PAM sequence: CTA
catactcagtaactgggctc

SEQ ID NO: 306223 - DNA, 20 bp, Artificial Sequence
  Description of Artificial Sequence: Synthetic oligonucleotide
  Target: ATXN1; (+) strand; PAM type: YTN; PAM sequence: CTC
agtaactgggctcagagaag

SEQ ID NO: 306224 - DNA, 20 bp, Artificial Sequence
  Description of Artificial Sequence: Synthetic oligonucleotide
  Target: ATXN1; (+) strand; PAM type: YTN; PAM sequence: CTG
ggctcagagaagacatctaa

SEQ ID NO: 306225 - DNA, 20 bp, Artificial Sequence
  Description of Artificial Sequence: Synthetic oligonucleotide
  Target: ATXN1; (+) strand; PAM type: YTN; PAM sequence: CTC
agagaagacatctaatatga

SEQ ID NO: 306226 - DNA, 20 bp, Artificial Sequence
  Description of Artificial Sequence: Synthetic oligonucleotide
  Target: ATXN1; (+) strand; PAM type: YTN; PAM sequence: CTA
atatgaataagaaaacaagt

SEQ ID NO: 306227 - DNA, 20 bp, Artificial Sequence
  Description of Artificial Sequence: Synthetic oligonucleotide
  Target: ATXN1; (+) strand; PAM type: YTN; PAM sequence: TTA
caatgtttcaagaagaaata

SEQ ID NO: 306228 - DNA, 20 bp, Artificial Sequence
  Description of Artificial Sequence: Synthetic oligonucleotide
  Target: ATXN1; (+) strand; PAM type: YTN; PAM sequence: TTT
caagaagaaatatagtttta

SEQ ID NO: 306229 - DNA, 20 bp, Artificial Sequence
  Description of Artificial Sequence: Synthetic oligonucleotide
  Target: ATXN1; (+) strand; PAM type: YTN; PAM sequence: TTC
aagaagaaatatagttttaa

SEQ ID NO: 306230 - DNA, 20 bp, Artificial Sequence
  Description of Artificial Sequence: Synthetic oligonucleotide
  Target: ATXN1; (+) strand; PAM type: YTN; PAM sequence: TTT
taactctcttaagtacttat

SEQ ID NO: 306231 - DNA, 20 bp, Artificial Sequence
  Description of Artificial Sequence: Synthetic oligonucleotide
  Target: ATXN1; (+) strand; PAM type: YTN; PAM sequence: TTT
aactctcttaagtacttata

SEQ ID NO: 306232 - DNA, 20 bp, Artificial Sequence
  Description of Artificial Sequence: Synthetic oligonucleotide
  Target: ATXN1; (+) strand; PAM type: YTN; PAM sequence: TTA
actctcttaagtacttataa

SEQ ID NO: 306233 - DNA, 20 bp, Artificial Sequence
  Description of Artificial Sequence: Synthetic oligonucleotide
  Target: ATXN1; (+) strand; PAM type: YTN; PAM sequence: CTC
tcttaagtacttataaaaaa

SEQ ID NO: 306234 - DNA, 20 bp, Artificial Sequence
  Description of Artificial Sequence: Synthetic oligonucleotide
  Target: ATXN1; (+) strand; PAM type: YTN; PAM sequence: CTC
ttaagtacttataaaaaaat

SEQ ID NO: 306235 - DNA, 20 bp, Artificial Sequence
  Description of Artificial Sequence: Synthetic oligonucleotide
  Target: ATXN1; (+) strand; PAM type: YTN; PAM sequence: CTT
aagtacttataaaaaaattt

SEQ ID NO: 306236 - DNA, 20 bp, Artificial Sequence
  Description of Artificial Sequence: Synthetic oligonucleotide
  Target: ATXN1; (+) strand; PAM type: YTN; PAM sequence: TTA
agtacttataaaaaaatttc

SEQ ID NO: 306237 - DNA, 20 bp, Artificial Sequence
  Description of Artificial Sequence: Synthetic oligonucleotide
  Target: ATXN1; (+) strand; PAM type: YTN; PAM sequence: CTT
ataaaaaaatttcaaaatga

SEQ ID NO: 306238 - DNA, 20 bp, Artificial Sequence
  Description of Artificial Sequence: Synthetic oligonucleotide
  Target: ATXN1; (+) strand; PAM type: YTN; PAM sequence: TTA
taaaaaaatttcaaaatgat

SEQ ID NO: 306239 - DNA, 20 bp, Artificial Sequence
  Description of Artificial Sequence: Synthetic oligonucleotide
  Target: ATXN1; (+) strand; PAM type: YTN; PAM sequence: TTT
caaaatgatcatcaaattac

SEQ ID NO: 306240 - DNA, 20 bp, Artificial Sequence
  Description of Artificial Sequence: Synthetic oligonucleotide
  Target: ATXN1; (+) strand; PAM type: YTN; PAM sequence: TTC
aaaatgatcatcaaattact

SEQ ID NO: 306241 - DNA, 20 bp, Artificial Sequence
  Description of Artificial Sequence: Synthetic oligonucleotide
  Target: ATXN1; (+) strand; PAM type: YTN; PAM sequence: TTA
cttaatgaatagactaagag

SEQ ID NO: 306242 - DNA, 20 bp, Artificial Sequence
  Description of Artificial Sequence: Synthetic oligonucleotide
  Target: ATXN1; (+) strand; PAM type: YTN; PAM sequence: CTT
aatgaatagactaagagagc

SEQ ID NO: 306243 - DNA, 20 bp, Artificial Sequence
  Description of Artificial Sequence: Synthetic oligonucleotide
  Target: ATXN1; (+) strand; PAM type: YTN; PAM sequence: TTA
atgaatagactaagagagct

SEQ ID NO: 306244 - DNA, 20 bp, Artificial Sequence
  Description of Artificial Sequence: Synthetic oligonucleotide
  Target: ATXN1; (+) strand; PAM type: YTN; PAM sequence: CTA
agagagcttatataataatg

SEQ ID NO: 306245 - DNA, 20 bp, Artificial Sequence
  Description of Artificial Sequence: Synthetic oligonucleotide
  Target: ATXN1; (+) strand; PAM type: YTN; PAM sequence: CTT
atataataatgtaatacaaa

SEQ ID NO: 306246 - DNA, 20 bp, Artificial Sequence
  Description of Artificial Sequence: Synthetic oligonucleotide
  Target: ATXN1; (+) strand; PAM type: YTN; PAM sequence: TTA
tataataatgtaatacaaat

SEQ ID NO: 306247 - DNA, 20 bp, Artificial Sequence
  Description of Artificial Sequence: Synthetic oligonucleotide
  Target: ATXN1; (+) strand; PAM type: YTN; PAM sequence: TTA
tgtatatataatcatataat

SEQ ID NO: 306248 - DNA, 20 bp, Artificial Sequence
  Description of Artificial Sequence: Synthetic oligonucleotide
  Target: ATXN1; (+) strand; PAM type: YTN; PAM sequence: CTT
ccaaagtgcttaaaaacaaa

SEQ ID NO: 306249 - DNA, 20 bp, Artificial Sequence
  Description of Artificial Sequence: Synthetic oligonucleotide
  Target: ATXN1; (+) strand; PAM type: YTN; PAM sequence: TTC
caaagtgcttaaaaacaaat

SEQ ID NO: 306250 - DNA, 20 bp, Artificial Sequence
  Description of Artificial Sequence: Synthetic oligonucleotide
  Target: ATXN1; (+) strand; PAM type: YTN; PAM sequence: CTT
aaaaacaaatttcctttatt

SEQ ID NO: 306251 - DNA, 20 bp, Artificial Sequence
  Description of Artificial Sequence: Synthetic oligonucleotide
  Target: ATXN1; (+) strand; PAM type: YTN; PAM sequence: TTA
aaaacaaatttcctttatta

SEQ ID NO: 306252 - DNA, 20 bp, Artificial Sequence
  Description of Artificial Sequence: Synthetic oligonucleotide
  Target: ATXN1; (+) strand; PAM type: YTN; PAM sequence: TTT
cctttattactgactcttag

SEQ ID NO: 306253 - DNA, 20 bp, Artificial Sequence
  Description of Artificial Sequence: Synthetic oligonucleotide
  Target: ATXN1; (+) strand; PAM type: YTN; PAM sequence: TTC
ctttattactgactcttagc

SEQ ID NO: 306254 - DNA, 20 bp, Artificial Sequence
  Description of Artificial Sequence: Synthetic oligonucleotide
  Target: ATXN1; (+) strand; PAM type: YTN; PAM sequence: CTT
tattactgactcttagctgt

SEQ ID NO: 306255 - DNA, 20 bp, Artificial Sequence
  Description of Artificial Sequence: Synthetic oligonucleotide
  Target: ATXN1; (+) strand; PAM type: YTN; PAM sequence: TTT
attactgactcttagctgtt

SEQ ID NO: 306256 - DNA, 20 bp, Artificial Sequence
  Description of Artificial Sequence: Synthetic oligonucleotide
  Target: ATXN1; (+) strand; PAM type: YTN; PAM sequence: TTA
ttactgactcttagctgtta

SEQ ID NO: 306257 - DNA, 20 bp, Artificial Sequence
  Description of Artificial Sequence: Synthetic oligonucleotide
  Target: ATXN1; (+) strand; PAM type: YTN; PAM sequence: TTA
ctgactcttagctgttatta

SEQ ID NO: 306258 - DNA, 20 bp, Artificial Sequence
  Description of Artificial Sequence: Synthetic oligonucleotide
  Target: ATXN1; (+) strand; PAM type: YTN; PAM sequence: CTG
actcttagctgttattagtc

SEQ ID NO: 306259 - DNA, 20 bp, Artificial Sequence
  Description of Artificial Sequence: Synthetic oligonucleotide
  Target: ATXN1; (+) strand; PAM type: YTN; PAM sequence: CTC
ttagctgttattagtctgtg

SEQ ID NO: 306260 - DNA, 20 bp, Artificial Sequence
  Description of Artificial Sequence: Synthetic oligonucleotide
  Target: ATXN1; (+) strand; PAM type: YTN; PAM sequence: CTT
agctgttattagtctgtgac

SEQ ID NO: 306261 - DNA, 20 bp, Artificial Sequence
  Description of Artificial Sequence: Synthetic oligonucleotide
  Target: ATXN1; (+) strand; PAM type: YTN; PAM sequence: TTA
gctgttattagtctgtgaca

SEQ ID NO: 306262 - DNA, 20 bp, Artificial Sequence
  Description of Artificial Sequence: Synthetic oligonucleotide
  Target: ATXN1; (+) strand; PAM type: YTN; PAM sequence: CTG
ttattagtctgtgacattat

SEQ ID NO: 306263 - DNA, 20 bp, Artificial Sequence
  Description of Artificial Sequence: Synthetic oligonucleotide
  Target: ATXN1; (+) strand; PAM type: YTN; PAM sequence: TTA
ttagtctgtgacattattta

SEQ ID NO: 306264 - DNA, 20 bp, Artificial Sequence
  Description of Artificial Sequence: Synthetic oligonucleotide
  Target: ATXN1; (+) strand; PAM type: YTN; PAM sequence: TTA
gtctgtgacattatttatat

SEQ ID NO: 306265 - DNA, 20 bp, Artificial Sequence
  Description of Artificial Sequence: Synthetic oligonucleotide
  Target: ATXN1; (+) strand; PAM type: YTN; PAM sequence: CTG
tgacattatttatattattt

SEQ ID NO: 306266 - DNA, 20 bp, Artificial Sequence
  Description of Artificial Sequence: Synthetic oligonucleotide
  Target: ATXN1; (+) strand; PAM type: YTN; PAM sequence: TTA
tttatattatttgttagcat

SEQ ID NO: 306267 - DNA, 20 bp, Artificial Sequence
  Description of Artificial Sequence: Synthetic oligonucleotide
  Target: ATXN1; (+) strand; PAM type: YTN; PAM sequence: TTT
atattatttgttagcataaa

SEQ ID NO: 306268 - DNA, 20 bp, Artificial Sequence
  Description of Artificial Sequence: Synthetic oligonucleotide
  Target: ATXN1; (+) strand; PAM type: YTN; PAM sequence: TTA
tattatttgttagcataaaa

SEQ ID NO: 306269 - DNA, 20 bp, Artificial Sequence
  Description of Artificial Sequence: Synthetic oligonucleotide
  Target: ATXN1; (+) strand; PAM type: YTN; PAM sequence: TTA
tttgttagcataaaaaatct

SEQ ID NO: 306270 - DNA, 20 bp, Artificial Sequence
  Description of Artificial Sequence: Synthetic oligonucleotide
  Target: ATXN1; (+) strand; PAM type: YTN; PAM sequence: TTT
gttagcataaaaaatctttt

SEQ ID NO: 306271 - DNA, 20 bp, Artificial Sequence
  Description of Artificial Sequence: Synthetic oligonucleotide
  Target: ATXN1; (+) strand; PAM type: YTN; PAM sequence: TTG
ttagcataaaaaatcttttc

SEQ ID NO: 306272 - DNA, 20 bp, Artificial Sequence
  Description of Artificial Sequence: Synthetic oligonucleotide
  Target: ATXN1; (+) strand; PAM type: YTN; PAM sequence: TTA
gcataaaaaatcttttcttc

SEQ ID NO: 306273 - DNA, 20 bp, Artificial Sequence
  Description of Artificial Sequence: Synthetic oligonucleotide
  Target: ATXN1; (+) strand; PAM type: YTN; PAM sequence: CTT
ttcttcttagacatattact

SEQ ID NO: 306274 - DNA, 20 bp, Artificial Sequence
  Description of Artificial Sequence: Synthetic oligonucleotide
  Target: ATXN1; (+) strand; PAM type: YTN; PAM sequence: TTT
tcttcttagacatattacta

SEQ ID NO: 306275 - DNA, 20 bp, Artificial Sequence
  Description of Artificial Sequence: Synthetic oligonucleotide
  Target: ATXN1; (+) strand; PAM type: YTN; PAM sequence: TTT
cttcttagacatattactaa

SEQ ID NO: 306276 - DNA, 20 bp, Artificial Sequence
  Description of Artificial Sequence: Synthetic oligonucleotide
  Target: ATXN1; (+) strand; PAM type: YTN; PAM sequence: TTC
ttcttagacatattactaat

SEQ ID NO: 306277 - DNA, 20 bp, Artificial Sequence
  Description of Artificial Sequence: Synthetic oligonucleotide
  Target: ATXN1; (+) strand; PAM type: YTN; PAM sequence: CTT
cttagacatattactaatat

SEQ ID NO: 306278 - DNA, 20 bp, Artificial Sequence
  Description of Artificial Sequence: Synthetic oligonucleotide
  Target: ATXN1; (+) strand; PAM type: YTN; PAM sequence: TTC
ttagacatattactaatata

SEQ ID NO: 306279 - DNA, 20 bp, Artificial Sequence
  Description of Artificial Sequence: Synthetic oligonucleotide
  Target: ATXN1; (+) strand; PAM type: YTN; PAM sequence: CTT
agacatattactaatataaa

SEQ ID NO: 306280 - DNA, 20 bp, Artificial Sequence
  Description of Artificial Sequence: Synthetic oligonucleotide
  Target: ATXN1; (+) strand; PAM type: YTN; PAM sequence: TTA
gacatattactaatataaat

SEQ ID NO: 306281 - DNA, 20 bp, Artificial Sequence
  Description of Artificial Sequence: Synthetic oligonucleotide
  Target: ATXN1; (+) strand; PAM type: YTN; PAM sequence: TTA
ctaatataaatattaattca

SEQ ID NO: 306282 - DNA, 20 bp, Artificial Sequence
  Description of Artificial Sequence: Synthetic oligonucleotide
  Target: ATXN1; (+) strand; PAM type: YTN; PAM sequence: CTA
atataaatattaattcaatg

SEQ ID NO: 306283 - DNA, 20 bp, Artificial Sequence
  Description of Artificial Sequence: Synthetic oligonucleotide
  Target: ATXN1; (+) strand; PAM type: YTN; PAM sequence: TTA
attcaatgtgtccacaaatt

SEQ ID NO: 306284 - DNA, 20 bp, Artificial Sequence
  Description of Artificial Sequence: Synthetic oligonucleotide
  Target: ATXN1; (+) strand; PAM type: YTN; PAM sequence: TTC
aatgtgtccacaaattcgga

SEQ ID NO: 306285 - DNA, 20 bp, Artificial Sequence
  Description of Artificial Sequence: Synthetic oligonucleotide
  Target: ATXN1; (+) strand; PAM type: YTN; PAM sequence: TTC
ggactataaaatgatcaaaa

SEQ ID NO: 306286 - DNA, 20 bp, Artificial Sequence
  Description of Artificial Sequence: Synthetic oligonucleotide
  Target: ATXN1; (+) strand; PAM type: YTN; PAM sequence: CTA
taaaatgatcaaaattaaca

SEQ ID NO: 306287 - DNA, 20 bp, Artificial Sequence
  Description of Artificial Sequence: Synthetic oligonucleotide
  Target: ATXN1; (+) strand; PAM type: YTN; PAM sequence: TTA
acaaaatttctgtctactga

SEQ ID NO: 306288 - DNA, 20 bp, Artificial Sequence
  Description of Artificial Sequence: Synthetic oligonucleotide
  Target: ATXN1; (+) strand; PAM type: YTN; PAM sequence: TTT
ctgtctactgaaagtgaaaa

SEQ ID NO: 306289 - DNA, 20 bp, Artificial Sequence
  Description of Artificial Sequence: Synthetic oligonucleotide
  Target: ATXN1; (+) strand; PAM type: YTN; PAM sequence: TTC
tgtctactgaaagtgaaaat

SEQ ID NO: 306290 - DNA, 20 bp, Artificial Sequence
  Description of Artificial Sequence: Synthetic oligonucleotide
  Target: ATXN1; (+) strand; PAM type: YTN; PAM sequence: CTG
tctactgaaagtgaaaattc

SEQ ID NO: 306291 - DNA, 20 bp, Artificial Sequence
  Description of Artificial Sequence: Synthetic oligonucleotide
  Target: ATXN1; (+) strand; PAM type: YTN; PAM sequence: CTA
ctgaaagtgaaaattcgtca

SEQ ID NO: 306292 - DNA, 20 bp, Artificial Sequence
  Description of Artificial Sequence: Synthetic oligonucleotide
  Target: ATXN1; (+) strand; PAM type: YTN; PAM sequence: CTG
aaagtgaaaattcgtcagag

SEQ ID NO: 306293 - DNA, 20 bp, Artificial Sequence
  Description of Artificial Sequence: Synthetic oligonucleotide
  Target: ATXN1; (+) strand; PAM type: YTN; PAM sequence: TTC
gtcagagaccgtttcctcca

SEQ ID NO: 306294 - DNA, 20 bp, Artificial Sequence
  Description of Artificial Sequence: Synthetic oligonucleotide
  Target: ATXN1; (+) strand; PAM type: YTN; PAM sequence: TTT
cctccatttaccaagccgag

SEQ ID NO: 306295 - DNA, 20 bp, Artificial Sequence
  Description of Artificial Sequence: Synthetic oligonucleotide
  Target: ATXN1; (+) strand; PAM type: YTN; PAM sequence: TTC
ctccatttaccaagccgaga

SEQ ID NO: 306296 - DNA, 20 bp, Artificial Sequence
  Description of Artificial Sequence: Synthetic oligonucleotide
  Target: ATXN1; (+) strand; PAM type: YTN; PAM sequence: CTC
catttaccaagccgagatgc

SEQ ID NO: 306297 - DNA, 20 bp, Artificial Sequence
  Description of Artificial Sequence: Synthetic oligonucleotide
  Target: ATXN1; (+) strand; PAM type: YTN; PAM sequence: TTT
accaagccgagatgccagtg

SEQ ID NO: 306298 - DNA, 20 bp, Artificial Sequence
  Description of Artificial Sequence: Synthetic oligonucleotide
  Target: ATXN1; (+) strand; PAM type: YTN; PAM sequence: TTA
ccaagccgagatgccagtgg

SEQ ID NO: 306299 - DNA, 20 bp, Artificial Sequence
  Description of Artificial Sequence: Synthetic oligonucleotide
  Target: ATXN1; (+) strand; PAM type: YTN; PAM sequence: TTT
aagccacaactgaccaactt

SEQ ID NO: 306300 - DNA, 20 bp, Artificial Sequence
  Description of Artificial Sequence: Synthetic oligonucleotide
  Target: ATXN1; (+) strand; PAM type: YTN; PAM sequence: TTA
agccacaactgaccaacttg

SEQ ID NO: 306301 - DNA, 20 bp, Artificial Sequence
  Description of Artificial Sequence: Synthetic oligonucleotide
  Target: ATXN1; (+) strand; PAM type: YTN; PAM sequence: CTG
accaacttgagactgcacat

SEQ ID NO: 306302 - DNA, 20 bp, Artificial Sequence
  Description of Artificial Sequence: Synthetic oligonucleotide
  Target: ATXN1; (+) strand; PAM type: YTN; PAM sequence: CTT
gagactgcacatttgttcat

SEQ ID NO: 306303 - DNA, 20 bp, Artificial Sequence
  Description of Artificial Sequence: Synthetic oligonucleotide
  Target: ATXN1; (+) strand; PAM type: YTN; PAM sequence: TTG
agactgcacatttgttcatt

SEQ ID NO: 306304 - DNA, 20 bp, Artificial Sequence
  Description of Artificial Sequence: Synthetic oligonucleotide
  Target: ATXN1; (+) strand; PAM type: YTN; PAM sequence: CTG
cacatttgttcattcattcg

SEQ ID NO: 306305 - DNA, 20 bp, Artificial Sequence
  Description of Artificial Sequence: Synthetic oligonucleotide
  Target: ATXN1; (+) strand; PAM type: YTN; PAM sequence: TTT
gttcattcattcgggccata

SEQ ID NO: 306306 - DNA, 20 bp, Artificial Sequence
  Description of Artificial Sequence: Synthetic oligonucleotide
  Target: ATXN1; (+) strand; PAM type: YTN; PAM sequence: TTG
ttcattcattcgggccatac

SEQ ID NO: 306307 - DNA, 20 bp, Artificial Sequence
  Description of Artificial Sequence: Synthetic oligonucleotide
  Target: ATXN1; (+) strand; PAM type: YTN; PAM sequence: TTC
attcattcgggccatactta

SEQ ID NO: 306308 - DNA, 20 bp, Artificial Sequence
  Description of Artificial Sequence: Synthetic oligonucleotide
  Target: ATXN1; (+) strand; PAM type: YTN; PAM sequence: TTC
attcgggccatacttattca

SEQ ID NO: 306309 - DNA, 20 bp, Artificial Sequence
  Description of Artificial Sequence: Synthetic oligonucleotide
  Target: ATXN1; (+) strand; PAM type: YTN; PAM sequence: TTC
gggccatacttattcaccat

SEQ ID NO: 306310 - DNA, 20 bp, Artificial Sequence
  Description of Artificial Sequence: Synthetic oligonucleotide
  Target: ATXN1; (+) strand; PAM type: YTN; PAM sequence: CTT
attcaccatctactactcta

SEQ ID NO: 306311 - DNA, 20 bp, Artificial Sequence
  Description of Artificial Sequence: Synthetic oligonucleotide
  Target: ATXN1; (+) strand; PAM type: YTN; PAM sequence: TTA
ttcaccatctactactctaa

SEQ ID NO: 306312 - DNA, 20 bp, Artificial Sequence
  Description of Artificial Sequence: Synthetic oligonucleotide
  Target: ATXN1; (+) strand; PAM type: YTN; PAM sequence: TTC
accatctactactctaaaat

SEQ ID NO: 306313 - DNA, 20 bp, Artificial Sequence
  Description of Artificial Sequence: Synthetic oligonucleotide
  Target: ATXN1; (+) strand; PAM type: YTN; PAM sequence: CTA
ctactctaaaatggggaagc

SEQ ID NO: 306314 - DNA, 20 bp, Artificial Sequence
  Description of Artificial Sequence: Synthetic oligonucleotide
  Target: ATXN1; (+) strand; PAM type: YTN; PAM sequence: CTA
ctctaaaatggggaagctgc

SEQ ID NO: 306315 - DNA, 20 bp, Artificial Sequence
  Description of Artificial Sequence: Synthetic oligonucleotide
  Target: ATXN1; (+) strand; PAM type: YTN; PAM sequence: CTC
taaaatggggaagctgcaag

SEQ ID NO: 306316 - DNA, 20 bp, Artificial Sequence
  Description of Artificial Sequence: Synthetic oligonucleotide
  Target: ATXN1; (+) strand; PAM type: YTN; PAM sequence: CTA
aaatggggaagctgcaaggg

SEQ ID NO: 306317 - DNA, 20 bp, Artificial Sequence
  Description of Artificial Sequence: Synthetic oligonucleotide
  Target: ATXN1; (+) strand; PAM type: YTN; PAM sequence: CTG
caagggcagctgtagaggtc

SEQ ID NO: 306318 - DNA, 20 bp, Artificial Sequence
  Description of Artificial Sequence: Synthetic oligonucleotide
  Target: ATXN1; (+) strand; PAM type: YTN; PAM sequence: CTG
tagaggtcacttggtctaga

SEQ ID NO: 306319 - DNA, 20 bp, Artificial Sequence
  Description of Artificial Sequence: Synthetic oligonucleotide
  Target: ATXN1; (+) strand; PAM type: YTN; PAM sequence: CTT
ggtctagaccctcattttgc

SEQ ID NO: 306320 - DNA, 20 bp, Artificial Sequence
  Description of Artificial Sequence: Synthetic oligonucleotide
  Target: ATXN1; (+) strand; PAM type: YTN; PAM sequence: TTG
gtctagaccctcattttgca

SEQ ID NO: 306321 - DNA, 20 bp, Artificial Sequence
  Description of Artificial Sequence: Synthetic oligonucleotide
  Target: ATXN1; (+) strand; PAM type: YTN; PAM sequence: CTA
gaccctcattttgcatgagg

SEQ ID NO: 306322 - DNA, 20 bp, Artificial Sequence
  Description of Artificial Sequence: Synthetic oligonucleotide
  Target: ATXN1; (+) strand; PAM type: YTN; PAM sequence: CTC
attttgcatgaggaggctgt

SEQ ID NO: 306323 - DNA, 20 bp, Artificial Sequence
  Description of Artificial Sequence: Synthetic oligonucleotide
  Target: ATXN1; (+) strand; PAM type: YTN; PAM sequence: TTT
tgcatgaggaggctgtgagg

SEQ ID NO: 306324 - DNA, 20 bp, Artificial Sequence
  Description of Artificial Sequence: Synthetic oligonucleotide
  Target: ATXN1; (+) strand; PAM type: YTN; PAM sequence: TTT
gcatgaggaggctgtgagga

SEQ ID NO: 306325 - DNA, 20 bp, Artificial Sequence
  Description of Artificial Sequence: Synthetic oligonucleotide
  Target: ATXN1; (+) strand; PAM type: YTN; PAM sequence: TTG
catgaggaggctgtgaggat

SEQ ID NO: 306326 - DNA, 20 bp, Artificial Sequence
  Description of Artificial Sequence: Synthetic oligonucleotide
  Target: ATXN1; (+) strand; PAM type: YTN; PAM sequence: CTG
tgaggattacagagattaaa

SEQ ID NO: 306327 - DNA, 20 bp, Artificial Sequence
  Description of Artificial Sequence: Synthetic oligonucleotide
  Target: ATXN1; (+) strand; PAM type: YTN; PAM sequence: TTA
cagagattaaacgcctggag

SEQ ID NO: 306328 - DNA, 20 bp, Artificial Sequence
  Description of Artificial Sequence: Synthetic oligonucleotide
  Target: ATXN1; (+) strand; PAM type: YTN; PAM sequence: TTA
aacgcctggagcatgctgag

SEQ ID NO: 306329 - DNA, 20 bp, Artificial Sequence
  Description of Artificial Sequence: Synthetic oligonucleotide
  Target: ATXN1; (+) strand; PAM type: YTN; PAM sequence: CTG
gagcatgctgagtttatcac

SEQ ID NO: 306330 - DNA, 20 bp, Artificial Sequence
  Description of Artificial Sequence: Synthetic oligonucleotide
  Target: ATXN1; (+) strand; PAM type: YTN; PAM sequence: CTG
agtttatcacagagaaaggg

SEQ ID NO: 306331 - DNA, 20 bp, Artificial Sequence
  Description of Artificial Sequence: Synthetic oligonucleotide
  Target: ATXN1; (+) strand; PAM type: YTN; PAM sequence: TTT
atcacagagaaagggctgga

SEQ ID NO: 306332 - DNA, 20 bp, Artificial Sequence
  Description of Artificial Sequence: Synthetic oligonucleotide
  Target: ATXN1; (+) strand; PAM type: YTN; PAM sequence: TTA
tcacagagaaagggctggag

SEQ ID NO: 306333 - DNA, 20 bp, Artificial Sequence
  Description of Artificial Sequence: Synthetic oligonucleotide
  Target: ATXN1; (+) strand; PAM type: YTN; PAM sequence: CTG
gagaagagagcaggtccctt

SEQ ID NO: 306334 - DNA, 20 bp, Artificial Sequence
  Description of Artificial Sequence: Synthetic oligonucleotide
  Target: ATXN1; (+) strand; PAM type: YTN; PAM sequence: CTT
ccctccctgctccttgctct

SEQ ID NO: 306335 - DNA, 20 bp, Artificial Sequence
  Description of Artificial Sequence: Synthetic oligonucleotide
  Target: ATXN1; (+) strand; PAM type: YTN; PAM sequence: TTC
cctccctgctccttgctctt

SEQ ID NO: 306336 - DNA, 20 bp, Artificial Sequence
  Description of Artificial Sequence: Synthetic oligonucleotide
  Target: ATXN1; (+) strand; PAM type: YTN; PAM sequence: CTC
cctgctccttgctctttctg

SEQ ID NO: 306337 - DNA, 20 bp, Artificial Sequence
  Description of Artificial Sequence: Synthetic oligonucleotide
  Target: ATXN1; (+) strand; PAM type: YTN; PAM sequence: CTG
ctccttgctctttctgccac

SEQ ID NO: 306338 - DNA, 20 bp, Artificial Sequence
  Description of Artificial Sequence: Synthetic oligonucleotide
  Target: ATXN1; (+) strand; PAM type: YTN; PAM sequence: CTC
cttgctctttctgccacact

SEQ ID NO: 306339 - DNA, 20 bp, Artificial Sequence
  Description of Artificial Sequence: Synthetic oligonucleotide
  Target: ATXN1; (+) strand; PAM type: YTN; PAM sequence: CTT
gctctttctgccacactacc

SEQ ID NO: 306340 - DNA, 20 bp, Artificial Sequence
  Description of Artificial Sequence: Synthetic oligonucleotide
  Target: ATXN1; (+) strand; PAM type: YTN; PAM sequence: TTG
ctctttctgccacactaccc

SEQ ID NO: 306341 - DNA, 20 bp, Artificial Sequence
  Description of Artificial Sequence: Synthetic oligonucleotide
  Target: ATXN1; (+) strand; PAM type: YTN; PAM sequence: CTC
tttctgccacactaccctgg

SEQ ID NO: 306342 - DNA, 20 bp, Artificial Sequence
  Description of Artificial Sequence: Synthetic oligonucleotide
  Target: ATXN1; (+) strand; PAM type: YTN; PAM sequence: CTT
tctgccacactaccctggag

SEQ ID NO: 306343 - DNA, 20 bp, Artificial Sequence
  Description of Artificial Sequence: Synthetic oligonucleotide
  Target: ATXN1; (+) strand; PAM type: YTN; PAM sequence: TTT
ctgccacactaccctggagc

SEQ ID NO: 306344 - DNA, 20 bp, Artificial Sequence
  Description of Artificial Sequence: Synthetic oligonucleotide
  Target: ATXN1; (+) strand; PAM type: YTN; PAM sequence: TTC
tgccacactaccctggagct

SEQ ID NO: 306345 - DNA, 20 bp, Artificial Sequence
  Description of Artificial Sequence: Synthetic oligonucleotide
  Target: ATXN1; (+) strand; PAM type: YTN; PAM sequence: CTG
ccacactaccctggagctga

SEQ ID NO: 306346 - DNA, 20 bp, Artificial Sequence
  Description of Artificial Sequence: Synthetic oligonucleotide
  Target: ATXN1; (+) strand; PAM type: YTN; PAM sequence: CTA
ccctggagctgaaaggaggc

SEQ ID NO: 306347 - DNA, 20 bp, Artificial Sequence
  Description of Artificial Sequence: Synthetic oligonucleotide
  Target: ATXN1; (+) strand; PAM type: YTN; PAM sequence: CTG
gagctgaaaggaggcaaagg

SEQ ID NO: 306348 - DNA, 20 bp, Artificial Sequence
  Description of Artificial Sequence: Synthetic oligonucleotide
  Target: ATXN1; (+) strand; PAM type: YTN; PAM sequence: CTG
aaaggaggcaaaggcctcca

SEQ ID NO: 306349 - DNA, 20 bp, Artificial Sequence
  Description of Artificial Sequence: Synthetic oligonucleotide
  Target: ATXN1; (+) strand; PAM type: YTN; PAM sequence: CTC
cagtcacatggagtctgact

SEQ ID NO: 306350 - DNA, 20 bp, Artificial Sequence
  Description of Artificial Sequence: Synthetic oligonucleotide
  Target: ATXN1; (+) strand; PAM type: YTN; PAM sequence: CTG
actgggacgcaagacatcta

SEQ ID NO: 306351 - DNA, 20 bp, Artificial Sequence
  Description of Artificial Sequence: Synthetic oligonucleotide
  Target: ATXN1; (+) strand; PAM type: YTN; PAM sequence: CTG
ggacgcaagacatctaagcc

SEQ ID NO: 306352 - DNA, 20 bp, Artificial Sequence
  Description of Artificial Sequence: Synthetic oligonucleotide
  Target: ATXN1; (+) strand; PAM type: YTN; PAM sequence: CTA
agccacaaaatgaagcaata

SEQ ID NO: 306353 - DNA, 20 bp, Artificial Sequence
  Description of Artificial Sequence: Synthetic oligonucleotide
  Target: ATXN1; (+) strand; PAM type: YTN; PAM sequence: CTG
tgcgcacagggcagtgggga

SEQ ID NO: 306354 - DNA, 20 bp, Artificial Sequence
  Description of Artificial Sequence: Synthetic oligonucleotide
  Target: ATXN1; (+) strand; PAM type: YTN; PAM sequence: TTG
gtttgggctgaagcagctgg

SEQ ID NO: 306355 - DNA, 20 bp, Artificial Sequence
  Description of Artificial Sequence: Synthetic oligonucleotide
  Target: ATXN1; (+) strand; PAM type: YTN; PAM sequence: TTT
gggctgaagcagctggggaa

SEQ ID NO: 306356 - DNA, 20 bp, Artificial Sequence
  Description of Artificial Sequence: Synthetic oligonucleotide
  Target: ATXN1; (+) strand; PAM type: YTN; PAM sequence: TTG
ggctgaagcagctggggaaa

SEQ ID NO: 306357 - DNA, 20 bp, Artificial Sequence
  Description of Artificial Sequence: Synthetic oligonucleotide
  Target: ATXN1; (+) strand; PAM type: YTN; PAM sequence: CTG
aagcagctggggaaaacttt

SEQ ID NO: 306358 - DNA, 20 bp, Artificial Sequence
  Description of Artificial Sequence: Synthetic oligonucleotide
  Target: ATXN1; (+) strand; PAM type: YTN; PAM sequence: CTG
gggaaaactttccgtcccgg

SEQ ID NO: 306359 - DNA, 20 bp, Artificial Sequence
  Description of Artificial Sequence: Synthetic oligonucleotide
  Target: ATXN1; (+) strand; PAM type: YTN; PAM sequence: CTT
tccgtcccggagaagtggag

SEQ ID NO: 306360 - DNA, 20 bp, Artificial Sequence
  Description of Artificial Sequence: Synthetic oligonucleotide
  Target: ATXN1; (+) strand; PAM type: YTN; PAM sequence: TTT
ccgtcccggagaagtggaga

SEQ ID NO: 306361 - DNA, 20 bp, Artificial Sequence
  Description of Artificial Sequence: Synthetic oligonucleotide
  Target: ATXN1; (+) strand; PAM type: YTN; PAM sequence: TTC
cgtcccggagaagtggagat

SEQ ID NO: 306362 - DNA, 20 bp, Artificial Sequence
  Description of Artificial Sequence: Synthetic oligonucleotide
  Target: ATXN1; (+) strand; PAM type: YTN; PAM sequence: TTC
atgctgggcatggacagtgg

SEQ ID NO: 306363 - DNA, 20 bp, Artificial Sequence
  Description of Artificial Sequence: Synthetic oligonucleotide
  Target: ATXN1; (+) strand; PAM type: YTN; PAM sequence: CTG
ggcatggacagtggggcaga

SEQ ID NO: 306364 - DNA, 20 bp, Artificial Sequence
  Description of Artificial Sequence: Synthetic oligonucleotide
  Target: ATXN1; (+) strand; PAM type: YTN; PAM sequence: CTG
ggaaccctcacagcaaagca

SEQ ID NO: 306365 - DNA, 20 bp, Artificial Sequence
  Description of Artificial Sequence: Synthetic oligonucleotide
  Target: ATXN1; (+) strand; PAM type: YTN; PAM sequence: CTC
acagcaaagcagggtggtca

SEQ ID NO: 306366 - DNA, 20 bp, Artificial Sequence
  Description of Artificial Sequence: Synthetic oligonucleotide
  Target: ATXN1; (+) strand; PAM type: YTN; PAM sequence: CTG
ggatgtaggacagaaaccag

SEQ ID NO: 306367 - DNA, 20 bp, Artificial Sequence
  Description of Artificial Sequence: Synthetic oligonucleotide
  Target: ATXN1; (+) strand; PAM type: YTN; PAM sequence: TTC
tgcccaccctttctacaact

SEQ ID NO: 306368 - DNA, 20 bp, Artificial Sequence
  Description of Artificial Sequence: Synthetic oligonucleotide
  Target: ATXN1; (+) strand; PAM type: YTN; PAM sequence: CTG
cccaccctttctacaactca

SEQ ID NO: 306369 - DNA, 20 bp, Artificial Sequence
  Description of Artificial Sequence: Synthetic oligonucleotide
  Target: ATXN1; (+) strand; PAM type: YTN; PAM sequence: CTT
tctacaactcaaggtctccc

SEQ ID NO: 306370 - DNA, 20 bp, Artificial Sequence
  Description of Artificial Sequence: Synthetic oligonucleotide
  Target: ATXN1; (+) strand; PAM type: YTN; PAM sequence: TTT
ctacaactcaaggtctccct

SEQ ID NO: 306371 - DNA, 20 bp, Artificial Sequence
  Description of Artificial Sequence: Synthetic oligonucleotide
  Target: ATXN1; (+) strand; PAM type: YTN; PAM sequence: TTC
tacaactcaaggtctccctc

SEQ ID NO: 306372 - DNA, 20 bp, Artificial Sequence
  Description of Artificial Sequence: Synthetic oligonucleotide
  Target: ATXN1; (+) strand; PAM type: YTN; PAM sequence: CTA
caactcaaggtctccctctc

SEQ ID NO: 306373 - DNA, 20 bp, Artificial Sequence
  Description of Artificial Sequence: Synthetic oligonucleotide
  Target: ATXN1; (+) strand; PAM type: YTN; PAM sequence: CTC
aaggtctccctctcaccaac

SEQ ID NO: 306374 - DNA, 20 bp, Artificial Sequence
  Description of Artificial Sequence: Synthetic oligonucleotide
  Target: ATXN1; (+) strand; PAM type: YTN; PAM sequence: CTC
cctctcaccaactccactac

SEQ ID NO: 306375 - DNA, 20 bp, Artificial Sequence
  Description of Artificial Sequence: Synthetic oligonucleotide
  Target: ATXN1; (+) strand; PAM type: YTN; PAM sequence: CTC
tcaccaactccactacacgc

SEQ ID NO: 306376 - DNA, 20 bp, Artificial Sequence
  Description of Artificial Sequence: Synthetic oligonucleotide
  Target: ATXN1; (+) strand; PAM type: YTN; PAM sequence: CTC
accaactccactacacgcca

SEQ ID NO: 306377 - DNA, 20 bp, Artificial Sequence
  Description of Artificial Sequence: Synthetic oligonucleotide
  Target: ATXN1; (+) strand; PAM type: YTN; PAM sequence: CTC
cactacacgccatcacccat

SEQ ID NO: 306378 - DNA, 20 bp, Artificial Sequence
  Description of Artificial Sequence: Synthetic oligonucleotide
  Target: ATXN1; (+) strand; PAM type: YTN; PAM sequence: CTA
cacgccatcacccatatgcc

SEQ ID NO: 306379 - DNA, 20 bp, Artificial Sequence
  Description of Artificial Sequence: Synthetic oligonucleotide
  Target: ATXN1; (+) strand; PAM type: YTN; PAM sequence: CTG
gtattttgccctaaatgcta

SEQ ID NO: 306380 - DNA, 20 bp, Artificial Sequence
  Description of Artificial Sequence: Synthetic oligonucleotide
  Target: ATXN1; (+) strand; PAM type: YTN; PAM sequence: TTT
tgccctaaatgctacacaaa

SEQ ID NO: 306381 - DNA, 20 bp, Artificial Sequence
  Description of Artificial Sequence: Synthetic oligonucleotide
  Target: ATXN1; (+) strand; PAM type: YTN; PAM sequence: TTT
gccctaaatgctacacaaat

SEQ ID NO: 306382 - DNA, 20 bp, Artificial Sequence
  Description of Artificial Sequence: Synthetic oligonucleotide
  Target: ATXN1; (+) strand; PAM type: YTN; PAM sequence: TTG
ccctaaatgctacacaaata

SEQ ID NO: 306383 - DNA, 20 bp, Artificial Sequence
  Description of Artificial Sequence: Synthetic oligonucleotide
  Target: ATXN1; (+) strand; PAM type: YTN; PAM sequence: CTA
aatgctacacaaataagtta

SEQ ID NO: 306384 - DNA, 20 bp, Artificial Sequence
  Description of Artificial Sequence: Synthetic oligonucleotide
  Target: ATXN1; (+) strand; PAM type: YTN; PAM sequence: CTA
cacaaataagttagaaaact

SEQ ID NO: 306385 - DNA, 20 bp, Artificial Sequence
  Description of Artificial Sequence: Synthetic oligonucleotide
  Target: ATXN1; (+) strand; PAM type: YTN; PAM sequence: TTA
gaaaactccaaaggagaatg

SEQ ID NO: 306386 - DNA, 20 bp, Artificial Sequence
  Description of Artificial Sequence: Synthetic oligonucleotide
  Target: ATXN1; (+) strand; PAM type: YTN; PAM sequence: CTC
caaaggagaatggtaatatc

SEQ ID NO: 306387 - DNA, 20 bp, Artificial Sequence
  Description of Artificial Sequence: Synthetic oligonucleotide
  Target: ATXN1; (+) strand; PAM type: YTN; PAM sequence: CTA
ggggtattacgtatattgat

SEQ ID NO: 306388 - DNA, 20 bp, Artificial Sequence
  Description of Artificial Sequence: Synthetic oligonucleotide
  Target: ATXN1; (+) strand; PAM type: YTN; PAM sequence: TTA
cgtatattgattttcttagt

SEQ ID NO: 306389 - DNA, 20 bp, Artificial Sequence
  Description of Artificial Sequence: Synthetic oligonucleotide
  Target: ATXN1; (+) strand; PAM type: YTN; PAM sequence: TTG
attttcttagtccttacatt

SEQ ID NO: 306390 - DNA, 20 bp, Artificial Sequence
  Description of Artificial Sequence: Synthetic oligonucleotide
  Target: ATXN1; (+) strand; PAM type: YTN; PAM sequence: TTT
tcttagtccttacattgact

SEQ ID NO: 306391 - DNA, 20 bp, Artificial Sequence
  Description of Artificial Sequence: Synthetic oligonucleotide
  Target: ATXN1; (+) strand; PAM type: YTN; PAM sequence: TTT
cttagtccttacattgacta

SEQ ID NO: 306392 - DNA, 20 bp, Artificial Sequence
  Description of Artificial Sequence: Synthetic oligonucleotide
  Target: ATXN1; (+) strand; PAM type: YTN; PAM sequence: TTC
ttagtccttacattgactat

SEQ ID NO: 306393 - DNA, 20 bp, Artificial Sequence
  Description of Artificial Sequence: Synthetic oligonucleotide
  Target: ATXN1; (+) strand; PAM type: YTN; PAM sequence: CTT
agtccttacattgactataa

SEQ ID NO: 306394 - DNA, 20 bp, Artificial Sequence
  Description of Artificial Sequence: Synthetic oligonucleotide
  Target: ATXN1; (+) strand; PAM type: YTN; PAM sequence: TTA
gtccttacattgactataat

SEQ ID NO: 306395 - DNA, 20 bp, Artificial Sequence
  Description of Artificial Sequence: Synthetic oligonucleotide
  Target: ATXN1; (+) strand; PAM type: YTN; PAM sequence: CTT
acattgactataatccccac

SEQ ID NO: 306396 - DNA, 20 bp, Artificial Sequence
  Description of Artificial Sequence: Synthetic oligonucleotide
  Target: ATXN1; (+) strand; PAM type: YTN; PAM sequence: TTA
cattgactataatccccact

SEQ ID NO: 306397 - DNA, 20 bp, Artificial Sequence
  Description of Artificial Sequence: Synthetic oligonucleotide
  Target: ATXN1; (+) strand; PAM type: YTN; PAM sequence: TTG
actataatccccactcttca

SEQ ID NO: 306398 - DNA, 20 bp, Artificial Sequence
  Description of Artificial Sequence: Synthetic oligonucleotide
  Target: ATXN1; (+) strand; PAM type: YTN; PAM sequence: CTA
taatccccactcttcagatg

SEQ ID NO: 306399 - DNA, 20 bp, Artificial Sequence
  Description of Artificial Sequence: Synthetic oligonucleotide
  Target: ATXN1; (+) strand; PAM type: YTN; PAM sequence: CTC
ttcagatgaagaaactgagg

SEQ ID NO: 306400 - DNA, 20 bp, Artificial Sequence
  Description of Artificial Sequence: Synthetic oligonucleotide
  Target: ATXN1; (+) strand; PAM type: YTN; PAM sequence: CTT
cagatgaagaaactgaggca

SEQ ID NO: 306401 - DNA, 20 bp, Artificial Sequence
  Description of Artificial Sequence: Synthetic oligonucleotide
  Target: ATXN1; (+) strand; PAM type: YTN; PAM sequence: TTC
agatgaagaaactgaggcac

SEQ ID NO: 306402 - DNA, 20 bp, Artificial Sequence
  Description of Artificial Sequence: Synthetic oligonucleotide
  Target: ATXN1; (+) strand; PAM type: YTN; PAM sequence: CTG
aggcacagataggttcaggg

SEQ ID NO: 306403 - DNA, 20 bp, Artificial Sequence
  Description of Artificial Sequence: Synthetic oligonucleotide
  Target: ATXN1; (+) strand; PAM type: YTN; PAM sequence: TTC
agggacttggccaaggtggt

SEQ ID NO: 306404 - DNA, 20 bp, Artificial Sequence
  Description of Artificial Sequence: Synthetic oligonucleotide
  Target: ATXN1; (+) strand; PAM type: YTN; PAM sequence: CTT
ggccaaggtggtaaatgtca

SEQ ID NO: 306405 - DNA, 20 bp, Artificial Sequence
  Description of Artificial Sequence: Synthetic oligonucleotide
  Target: ATXN1; (+) strand; PAM type: YTN; PAM sequence: TTG
gccaaggtggtaaatgtcaa

SEQ ID NO: 306406 - DNA, 20 bp, Artificial Sequence
  Description of Artificial Sequence: Synthetic oligonucleotide
  Target: ATXN1; (+) strand; PAM type: YTN; PAM sequence: CTG
gtattcgaactagagagata

SEQ ID NO: 306407 - DNA, 20 bp, Artificial Sequence
  Description of Artificial Sequence: Synthetic oligonucleotide
  Target: ATXN1; (+) strand; PAM type: YTN; PAM sequence: TTC
gaactagagagatatcaaaa

SEQ ID NO: 306408 - DNA, 20 bp, Artificial Sequence
  Description of Artificial Sequence: Synthetic oligonucleotide
  Target: ATXN1; (+) strand; PAM type: YTN; PAM sequence: CTA
gagagatatcaaaattctgg

SEQ ID NO: 306409 - DNA, 20 bp, Artificial Sequence
  Description of Artificial Sequence: Synthetic oligonucleotide
  Target: ATXN1; (+) strand; PAM type: YTN; PAM sequence: TTC
tggtatacccaaccacagat

SEQ ID NO: 306410 - DNA, 20 bp, Artificial Sequence
  Description of Artificial Sequence: Synthetic oligonucleotide
  Target: ATXN1; (+) strand; PAM type: YTN; PAM sequence: CTG
gtatacccaaccacagatga

SEQ ID NO: 306411 - DNA, 20 bp, Artificial Sequence
  Description of Artificial Sequence: Synthetic oligonucleotide
  Target: ATXN1; (+) strand; PAM type: YTN; PAM sequence: CTT
caccaagtgtggatcccagc

SEQ ID NO: 306412 - DNA, 20 bp, Artificial Sequence
  Description of Artificial Sequence: Synthetic oligonucleotide
  Target: ATXN1; (+) strand; PAM type: YTN; PAM sequence: TTC
accaagtgtggatcccagct

SEQ ID NO: 306413 - DNA, 20 bp, Artificial Sequence
  Description of Artificial Sequence: Synthetic oligonucleotide
  Target: ATXN1; (+) strand; PAM type: YTN; PAM sequence: CTG
caggacagcttggcattccc

SEQ ID NO: 306414 - DNA, 20 bp, Artificial Sequence
  Description of Artificial Sequence: Synthetic oligonucleotide
  Target: ATXN1; (+) strand; PAM type: YTN; PAM sequence: CTT
ggcattcccttccccgtcac

SEQ ID NO: 306415 - DNA, 20 bp, Artificial Sequence
  Description of Artificial Sequence: Synthetic oligonucleotide
  Target: ATXN1; (+) strand; PAM type: YTN; PAM sequence: TTG
gcattcccttccccgtcacc

SEQ ID NO: 306416 - DNA, 20 bp, Artificial Sequence
  Description of Artificial Sequence: Synthetic oligonucleotide
  Target: ATXN1; (+) strand; PAM type: YTN; PAM sequence: TTC
ccttccccgtcacccagctt

SEQ ID NO: 306417 - DNA, 20 bp, Artificial Sequence
  Description of Artificial Sequence: Synthetic oligonucleotide
  Target: ATXN1; (+) strand; PAM type: YTN; PAM sequence: CTT
ccccgtcacccagcttctat

SEQ ID NO: 306418 - DNA, 20 bp, Artificial Sequence
  Description of Artificial Sequence: Synthetic oligonucleotide
  Target: ATXN1; (+) strand; PAM type: YTN; PAM sequence: TTC
cccgtcacccagcttctatt

SEQ ID NO: 306419 - DNA, 20 bp, Artificial Sequence
  Description of Artificial Sequence: Synthetic oligonucleotide
  Target: ATXN1; (+) strand; PAM type: YTN; PAM sequence: CTT
ctattccttcccattctcct

SEQ ID NO: 306420 - DNA, 20 bp, Artificial Sequence
  Description of Artificial Sequence: Synthetic oligonucleotide
  Target: ATXN1; (+) strand; PAM type: YTN; PAM sequence: TTC
tattccttcccattctcctt

SEQ ID NO: 306421 - DNA, 20 bp, Artificial Sequence
  Description of Artificial Sequence: Synthetic oligonucleotide
  Target: ATXN1; (+) strand; PAM type: YTN; PAM sequence: CTA
ttccttcccattctccttct

SEQ ID NO: 306422 - DNA, 20 bp, Artificial Sequence
  Description of Artificial Sequence: Synthetic oligonucleotide
  Target: ATXN1; (+) strand; PAM type: YTN; PAM sequence: TTC
cttcccattctccttctatt

SEQ ID NO: 306423 - DNA, 20 bp, Artificial Sequence
  Description of Artificial Sequence: Synthetic oligonucleotide
  Target: ATXN1; (+) strand; PAM type: YTN; PAM sequence: CTT
cccattctccttctatttat

SEQ ID NO: 306424 - DNA, 20 bp, Artificial Sequence
  Description of Artificial Sequence: Synthetic oligonucleotide
  Target: ATXN1; (+) strand; PAM type: YTN; PAM sequence: TTC
ccattctccttctatttatt

SEQ ID NO: 306425 - DNA, 20 bp, Artificial Sequence
  Description of Artificial Sequence: Synthetic oligonucleotide
  Target: ATXN1; (+) strand; PAM type: YTN; PAM sequence: TTC
tccttctatttattcctagt

SEQ ID NO: 306426 - DNA, 20 bp, Artificial Sequence
  Description of Artificial Sequence: Synthetic oligonucleotide
  Target: ATXN1; (+) strand; PAM type: YTN; PAM sequence: CTC
cttctatttattcctagtta

SEQ ID NO: 306427 - DNA, 20 bp, Artificial Sequence
  Description of Artificial Sequence: Synthetic oligonucleotide
  Target: ATXN1; (+) strand; PAM type: YTN; PAM sequence: CTT
ctatttattcctagttacta

SEQ ID NO: 306428 - DNA, 20 bp, Artificial Sequence
  Description of Artificial Sequence: Synthetic oligonucleotide
  Target: ATXN1; (+) strand; PAM type: YTN; PAM sequence: TTC
tatttattcctagttactaa

SEQ ID NO: 306429 - DNA, 20 bp, Artificial Sequence
  Description of Artificial Sequence: Synthetic oligonucleotide
  Target: ATXN1; (+) strand; PAM type: YTN; PAM sequence: CTA
tttattcctagttactaaga

SEQ ID NO: 306430 - DNA, 20 bp, Artificial Sequence
  Description of Artificial Sequence: Synthetic oligonucleotide
  Target: ATXN1; (+) strand; PAM type: YTN; PAM sequence: TTT
attcctagttactaagaatt

SEQ ID NO: 306431 - DNA, 20 bp, Artificial Sequence
  Description of Artificial Sequence: Synthetic oligonucleotide
  Target: ATXN1; (+) strand; PAM type: YTN; PAM sequence: TTA
ttcctagttactaagaattt

SEQ ID NO: 306432 - DNA, 20 bp, Artificial Sequence
  Description of Artificial Sequence: Synthetic oligonucleotide
  Target: ATXN1; (+) strand; PAM type: YTN; PAM sequence: TTC
ctagttactaagaattttta

SEQ ID NO: 306433 - DNA, 20 bp, Artificial Sequence
  Description of Artificial Sequence: Synthetic oligonucleotide
  Target: ATXN1; (+) strand; PAM type: YTN; PAM sequence: CTA
gttactaagaatttttaagg

SEQ ID NO: 306434 - DNA, 20 bp, Artificial Sequence
  Description of Artificial Sequence: Synthetic oligonucleotide
  Target: ATXN1; (+) strand; PAM type: YTN; PAM sequence: TTA
ctaagaatttttaaggtgct

SEQ ID NO: 306435 - DNA, 20 bp, Artificial Sequence
  Description of Artificial Sequence: Synthetic oligonucleotide
  Target: ATXN1; (+) strand; PAM type: YTN; PAM sequence: CTA
agaatttttaaggtgctatc

SEQ ID NO: 306436 - DNA, 20 bp, Artificial Sequence
  Description of Artificial Sequence: Synthetic oligonucleotide
  Target: ATXN1; (+) strand; PAM type: YTN; PAM sequence: TTT
ttaaggtgctatcacacctc

SEQ ID NO: 306437 - DNA, 20 bp, Artificial Sequence
  Description of Artificial Sequence: Synthetic oligonucleotide
  Target: ATXN1; (+) strand; PAM type: YTN; PAM sequence: TTT
taaggtgctatcacacctcc

SEQ ID NO: 306438 - DNA, 20 bp, Artificial Sequence
  Description of Artificial Sequence: Synthetic oligonucleotide
  Target: ATXN1; (+) strand; PAM type: YTN; PAM sequence: TTT
aaggtgctatcacacctcca

SEQ ID NO: 306439 - DNA, 20 bp, Artificial Sequence
  Description of Artificial Sequence: Synthetic oligonucleotide
  Target: ATXN1; (+) strand; PAM type: YTN; PAM sequence: TTA
aggtgctatcacacctccag

SEQ ID NO: 306440 - DNA, 20 bp, Artificial Sequence
  Description of Artificial Sequence: Synthetic oligonucleotide
  Target: ATXN1; (+) strand; PAM type: YTN; PAM sequence: CTA
tcacacctccagggctactt

SEQ ID NO: 306441 - DNA, 20 bp, Artificial Sequence
  Description of Artificial Sequence: Synthetic oligonucleotide
  Target: ATXN1; (+) strand; PAM type: YTN; PAM sequence: CTC
cagggctacttccaaaagcc

SEQ ID NO: 306442 - DNA, 20 bp, Artificial Sequence
  Description of Artificial Sequence: Synthetic oligonucleotide
  Target: ATXN1; (+) strand; PAM type: YTN; PAM sequence: CTA
cttccaaaagcctagtcgag

SEQ ID NO: 306443 - DNA, 20 bp, Artificial Sequence
  Description of Artificial Sequence: Synthetic oligonucleotide
  Target: ATXN1; (+) strand; PAM type: YTN; PAM sequence: CTT
ccaaaagcctagtcgagctg

SEQ ID NO: 306444 - DNA, 20 bp, Artificial Sequence
  Description of Artificial Sequence: Synthetic oligonucleotide
  Target: ATXN1; (+) strand; PAM type: YTN; PAM sequence: TTC
caaaagcctagtcgagctga

SEQ ID NO: 306445 - DNA, 20 bp, Artificial Sequence
  Description of Artificial Sequence: Synthetic oligonucleotide
  Target: ATXN1; (+) strand; PAM type: YTN; PAM sequence: CTA
gtcgagctgactcaaaggga

SEQ ID NO: 306446 - DNA, 20 bp, Artificial Sequence
  Description of Artificial Sequence: Synthetic oligonucleotide
  Target: ATXN1; (+) strand; PAM type: YTN; PAM sequence: CTG
actcaaagggaaggttcttt

SEQ ID NO: 306447 - DNA, 20 bp, Artificial Sequence
  Description of Artificial Sequence: Synthetic oligonucleotide
  Target: ATXN1; (+) strand; PAM type: YTN; PAM sequence: CTC
aaagggaaggttctttaggg

SEQ ID NO: 306448 - DNA, 20 bp, Artificial Sequence
  Description of Artificial Sequence: Synthetic oligonucleotide
  Target: ATXN1; (+) strand; PAM type: YTN; PAM sequence: TTC
tttagggacctcagcaatcc

SEQ ID NO: 306449 - DNA, 20 bp, Artificial Sequence
  Description of Artificial Sequence: Synthetic oligonucleotide
  Target: ATXN1; (+) strand; PAM type: YTN; PAM sequence: CTT
tagggacctcagcaatccaa

SEQ ID NO: 306450 - DNA, 20 bp, Artificial Sequence
  Description of Artificial Sequence: Synthetic oligonucleotide
  Target: ATXN1; (+) strand; PAM type: YTN; PAM sequence: TTT
agggacctcagcaatccaaa

SEQ ID NO: 306451 - DNA, 20 bp, Artificial Sequence
  Description of Artificial Sequence: Synthetic oligonucleotide
  Target: ATXN1; (+) strand; PAM type: YTN; PAM sequence: TTA
gggacctcagcaatccaaac

SEQ ID NO: 306452 - DNA, 20 bp, Artificial Sequence
  Description of Artificial Sequence: Synthetic oligonucleotide
  Target: ATXN1; (+) strand; PAM type: YTN; PAM sequence: CTC
agcaatccaaacacagcaga

SEQ ID NO: 306453 - DNA, 20 bp, Artificial Sequence
  Description of Artificial Sequence: Synthetic oligonucleotide
  Target: ATXN1; (+) strand; PAM type: YTN; PAM sequence: CTG
agaaatcctgaaacaagtct

SEQ ID NO: 306454 - DNA, 20 bp, Artificial Sequence
  Description of Artificial Sequence: Synthetic oligonucleotide
  Target: ATXN1; (+) strand; PAM type: YTN; PAM sequence: CTG
aaacaagtcttcctacagaa

SEQ ID NO: 306455 - DNA, 20 bp, Artificial Sequence
  Description of Artificial Sequence: Synthetic oligonucleotide
  Target: ATXN1; (+) strand; PAM type: YTN; PAM sequence: CTT
cctacagaatgatgactgcc

SEQ ID NO: 306456 - DNA, 20 bp, Artificial Sequence
  Description of Artificial Sequence: Synthetic oligonucleotide
  Target: ATXN1; (+) strand; PAM type: YTN; PAM sequence: TTC
ctacagaatgatgactgcct

SEQ ID NO: 306457 - DNA, 20 bp, Artificial Sequence
  Description of Artificial Sequence: Synthetic oligonucleotide
  Target: ATXN1; (+) strand; PAM type: YTN; PAM sequence: CTA
cagaatgatgactgcctgcc

SEQ ID NO: 306458 - DNA, 20 bp, Artificial Sequence
  Description of Artificial Sequence: Synthetic oligonucleotide
  Target: ATXN1; (+) strand; PAM type: YTN; PAM sequence: CTG
cctgcctctctggcaactga

SEQ ID NO: 306459 - DNA, 20 bp, Artificial Sequence
  Description of Artificial Sequence: Synthetic oligonucleotide
  Target: ATXN1; (+) strand; PAM type: YTN; PAM sequence: CTG
cctctctggcaactgagaat

SEQ ID NO: 306460 - DNA, 20 bp, Artificial Sequence
  Description of Artificial Sequence: Synthetic oligonucleotide
  Target: ATXN1; (+) strand; PAM type: YTN; PAM sequence: CTC
tctggcaactgagaatgggt

SEQ ID NO: 306461 - DNA, 20 bp, Artificial Sequence
  Description of Artificial Sequence: Synthetic oligonucleotide
  Target: ATXN1; (+) strand; PAM type: YTN; PAM sequence: CTC
tggcaactgagaatgggttt

SEQ ID NO: 306462 - DNA, 20 bp, Artificial Sequence
  Description of Artificial Sequence: Synthetic oligonucleotide
  Target: ATXN1; (+) strand; PAM type: YTN; PAM sequence: CTG
gcaactgagaatgggtttta

SEQ ID NO: 306463 - DNA, 20 bp, Artificial Sequence
  Description of Artificial Sequence: Synthetic oligonucleotide
  Target: ATXN1; (+) strand; PAM type: YTN; PAM sequence: CTG
agaatgggttttaaaaacat

SEQ ID NO: 306464 - DNA, 20 bp, Artificial Sequence
  Description of Artificial Sequence: Synthetic oligonucleotide
  Target: ATXN1; (+) strand; PAM type: YTN; PAM sequence: TTT
taaaaacatcctcctttact

SEQ ID NO: 306465 - DNA, 20 bp, Artificial Sequence
  Description of Artificial Sequence: Synthetic oligonucleotide
  Target: ATXN1; (+) strand; PAM type: YTN; PAM sequence: TTT
aaaaacatcctcctttactg

SEQ ID NO: 306466 - DNA, 20 bp, Artificial Sequence
  Description of Artificial Sequence: Synthetic oligonucleotide
  Target: ATXN1; (+) strand; PAM type: YTN; PAM sequence: TTA
aaaacatcctcctttactgt

SEQ ID NO: 306467 - DNA, 20 bp, Artificial Sequence
  Description of Artificial Sequence: Synthetic oligonucleotide
  Target: ATXN1; (+) strand; PAM type: YTN; PAM sequence: CTC
ctttactgtacaaagtatct

SEQ ID NO: 306468 - DNA, 20 bp, Artificial Sequence
  Description of Artificial Sequence: Synthetic oligonucleotide
  Target: ATXN1; (+) strand; PAM type: YTN; PAM sequence: CTT
tactgtacaaagtatctggt

SEQ ID NO: 306469 - DNA, 20 bp, Artificial Sequence
  Description of Artificial Sequence: Synthetic oligonucleotide
  Target: ATXN1; (+) strand; PAM type: YTN; PAM sequence: TTT
actgtacaaagtatctggtc

SEQ ID NO: 306470 - DNA, 20 bp, Artificial Sequence
  Description of Artificial Sequence: Synthetic oligonucleotide
  Target: ATXN1; (+) strand; PAM type: YTN; PAM sequence: TTA
ctgtacaaagtatctggtca

SEQ ID NO: 306471 - DNA, 20 bp, Artificial Sequence
  Description of Artificial Sequence: Synthetic oligonucleotide
  Target: ATXN1; (+) strand; PAM type: YTN; PAM sequence: CTG
tacaaagtatctggtcacaa

SEQ ID NO: 306472 - DNA, 20 bp, Artificial Sequence
  Description of Artificial Sequence: Synthetic oligonucleotide
  Target: ATXN1; (+) strand; PAM type: YTN; PAM sequence: CTG
gtcacaaagtttgttattgg

SEQ ID NO: 306473 - DNA, 20 bp, Artificial Sequence
  Description of Artificial Sequence: Synthetic oligonucleotide
  Target: ATXN1; (+) strand; PAM type: YTN; PAM sequence: TTT
gttattggcagaaccaggat

SEQ ID NO: 306474 - DNA, 20 bp, Artificial Sequence
  Description of Artificial Sequence: Synthetic oligonucleotide
  Target: ATXN1; (+) strand; PAM type: YTN; PAM sequence: TTG
ttattggcagaaccaggatt

SEQ ID NO: 306475 - DNA, 20 bp, Artificial Sequence
  Description of Artificial Sequence: Synthetic oligonucleotide
  Target: ATXN1; (+) strand; PAM type: YTN; PAM sequence: TTA
ttggcagaaccaggattaaa

SEQ ID NO: 306476 - DNA, 20 bp, Artificial Sequence
  Description of Artificial Sequence: Synthetic oligonucleotide
  Target: ATXN1; (+) strand; PAM type: YTN; PAM sequence: TTG
gcagaaccaggattaaaaat

SEQ ID NO: 306477 - DNA, 20 bp, Artificial Sequence
  Description of Artificial Sequence: Synthetic oligonucleotide
  Target: ATXN1; (+) strand; PAM type: YTN; PAM sequence: TTA
aaaattatgacctctgcctt

SEQ ID NO: 306478 - DNA, 20 bp, Artificial Sequence
  Description of Artificial Sequence: Synthetic oligonucleotide
  Target: ATXN1; (+) strand; PAM type: YTN; PAM sequence: TTA
tgacctctgccttttttctc

SEQ ID NO: 306479 - DNA, 20 bp, Artificial Sequence
  Description of Artificial Sequence: Synthetic oligonucleotide
  Target: ATXN1; (+) strand; PAM type: YTN; PAM sequence: CTC
tgccttttttctctctcacc

SEQ ID NO: 306480 - DNA, 20 bp, Artificial Sequence
  Description of Artificial Sequence: Synthetic oligonucleotide
  Target: ATXN1; (+) strand; PAM type: YTN; PAM sequence: CTG
ccttttttctctctcaccct

SEQ ID NO: 306481 - DNA, 20 bp, Artificial Sequence
  Description of Artificial Sequence: Synthetic oligonucleotide
  Target: ATXN1; (+) strand; PAM type: YTN; PAM sequence: CTT
ttttctctctcacccttatt

SEQ ID NO: 306482 - DNA, 20 bp, Artificial Sequence
  Description of Artificial Sequence: Synthetic oligonucleotide
  Target: ATXN1; (+) strand; PAM type: YTN; PAM sequence: TTT
tttctctctcacccttattc

SEQ ID NO: 306483 - DNA, 20 bp, Artificial Sequence
  Description of Artificial Sequence: Synthetic oligonucleotide
  Target: ATXN1; (+) strand; PAM type: YTN; PAM sequence: TTT
ttctctctcacccttattct

SEQ ID NO: 306484 - DNA, 20 bp, Artificial Sequence
  Description of Artificial Sequence: Synthetic oligonucleotide
  Target: ATXN1; (+) strand; PAM type: YTN; PAM sequence: TTT
tctctctcacccttattctc

SEQ ID NO: 306485 - DNA, 20 bp, Artificial Sequence
  Description of Artificial Sequence: Synthetic oligonucleotide
  Target: ATXN1; (+) strand; PAM type: YTN; PAM sequence: TTT
ctctctcacccttattctcc

SEQ ID NO: 306486 - DNA, 20 bp, Artificial Sequence
  Description of Artificial Sequence: Synthetic oligonucleotide
  Target: ATXN1; (+) strand; PAM type: YTN; PAM sequence: TTC
tctctcacccttattctccc

SEQ ID NO: 306487 - DNA, 20 bp, Artificial Sequence
  Description of Artificial Sequence: Synthetic oligonucleotide
  Target: ATXN1; (+) strand; PAM type: YTN; PAM sequence: CTC
tctcacccttattctcccaa

SEQ ID NO: 306488 - DNA, 20 bp, Artificial Sequence
  Description of Artificial Sequence: Synthetic oligonucleotide
  Target: ATXN1; (+) strand; PAM type: YTN; PAM sequence: CTC
tcacccttattctcccaagg

SEQ ID NO: 306489 - DNA, 20 bp, Artificial Sequence
  Description of Artificial Sequence: Synthetic oligonucleotide
  Target: ATXN1; (+) strand; PAM type: YTN; PAM sequence: CTC
acccttattctcccaaggtg

SEQ ID NO: 306490 - DNA, 20 bp, Artificial Sequence
  Description of Artificial Sequence: Synthetic oligonucleotide
  Target: ATXN1; (+) strand; PAM type: YTN; PAM sequence: CTT
attctcccaaggtgtatatt

SEQ ID NO: 306491 - DNA, 20 bp, Artificial Sequence
  Description of Artificial Sequence: Synthetic oligonucleotide
  Target: ATXN1; (+) strand; PAM type: YTN; PAM sequence: TTA
ttctcccaaggtgtatattt

SEQ ID NO: 306492 - DNA, 20 bp, Artificial Sequence
  Description of Artificial Sequence: Synthetic oligonucleotide
  Target: ATXN1; (+) strand; PAM type: YTN; PAM sequence: TTC
tcccaaggtgtatatttata

SEQ ID NO: 306493 - DNA, 20 bp, Artificial Sequence
  Description of Artificial Sequence: Synthetic oligonucleotide
  Target: ATXN1; (+) strand; PAM type: YTN; PAM sequence: CTC
ccaaggtgtatatttatatg

SEQ ID NO: 306494 - DNA, 20 bp, Artificial Sequence
  Description of Artificial Sequence: Synthetic oligonucleotide
  Target: ATXN1; (+) strand; PAM type: YTN; PAM sequence: TTT
atatgttttgcaaagtagcc

SEQ ID NO: 306495 - DNA, 20 bp, Artificial Sequence
  Description of Artificial Sequence: Synthetic oligonucleotide
  Target: ATXN1; (+) strand; PAM type: YTN; PAM sequence: TTA
tatgttttgcaaagtagcca

SEQ ID NO: 306496 - DNA, 20 bp, Artificial Sequence
  Description of Artificial Sequence: Synthetic oligonucleotide
  Target: ATXN1; (+) strand; PAM type: YTN; PAM sequence: TTT
tgcaaagtagccaaaggcag

SEQ ID NO: 306497 - DNA, 20 bp, Artificial Sequence
  Description of Artificial Sequence: Synthetic oligonucleotide
  Target: ATXN1; (+) strand; PAM type: YTN; PAM sequence: TTT
gcaaagtagccaaaggcaga

SEQ ID NO: 306498 - DNA, 20 bp, Artificial Sequence
  Description of Artificial Sequence: Synthetic oligonucleotide
  Target: ATXN1; (+) strand; PAM type: YTN; PAM sequence: TTG
caaagtagccaaaggcagac

SEQ ID NO: 306499 - DNA, 20 bp, Artificial Sequence
  Description of Artificial Sequence: Synthetic oligonucleotide
  Target: ATXN1; (+) strand; PAM type: YTN; PAM sequence: CTT
caaaaggagctttcctgtgg

SEQ ID NO: 306500 - DNA, 20 bp, Artificial Sequence
  Description of Artificial Sequence: Synthetic oligonucleotide
  Target: ATXN1; (+) strand; PAM type: YTN; PAM sequence: TTC
aaaaggagctttcctgtggg

SEQ ID NO: 306501 - DNA, 20 bp, Artificial Sequence
  Description of Artificial Sequence: Synthetic oligonucleotide
  Target: ATXN1; (+) strand; PAM type: YTN; PAM sequence: CTT
tcctgtggggtgagcggtaa

SEQ ID NO: 306502 - DNA, 20 bp, Artificial Sequence
  Description of Artificial Sequence: Synthetic oligonucleotide
  Target: ATXN1; (+) strand; PAM type: YTN; PAM sequence: TTT
cctgtggggtgagcggtaaa

SEQ ID NO: 306503 - DNA, 20 bp, Artificial Sequence
  Description of Artificial Sequence: Synthetic oligonucleotide
  Target: ATXN1; (+) strand; PAM type: YTN; PAM sequence: TTC
ctgtggggtgagcggtaaat

SEQ ID NO: 306504 - DNA, 20 bp, Artificial Sequence
  Description of Artificial Sequence: Synthetic oligonucleotide
  Target: ATXN1; (+) strand; PAM type: YTN; PAM sequence: CTG
tggggtgagcggtaaatgaa

SEQ ID NO: 306505 - DNA, 20 bp, Artificial Sequence
  Description of Artificial Sequence: Synthetic oligonucleotide
  Target: ATXN1; (+) strand; PAM type: YTN; PAM sequence: CTG
gactgagagagcaaagagaa

SEQ ID NO: 306506 - DNA, 20 bp, Artificial Sequence
  Description of Artificial Sequence: Synthetic oligonucleotide
  Target: ATXN1; (+) strand; PAM type: YTN; PAM sequence: CTG
agagagcaaagagaaaatga

SEQ ID NO: 306507 - DNA, 20 bp, Artificial Sequence
  Description of Artificial Sequence: Synthetic oligonucleotide
  Target: ATXN1; (+) strand; PAM type: YTN; PAM sequence: TTG
tgttaaatatataagcgttc

SEQ ID NO: 306508 - DNA, 20 bp, Artificial Sequence
  Description of Artificial Sequence: Synthetic oligonucleotide
  Target: ATXN1; (+) strand; PAM type: YTN; PAM sequence: TTA
aatatataagcgttcgctgg

SEQ ID NO: 306509 - DNA, 20 bp, Artificial Sequence
  Description of Artificial Sequence: Synthetic oligonucleotide
  Target: ATXN1; (+) strand; PAM type: YTN; PAM sequence: TTC
gctggctttctttgaaatgt

SEQ ID NO: 306510 - DNA, 20 bp, Artificial Sequence
  Description of Artificial Sequence: Synthetic oligonucleotide
  Target: ATXN1; (+) strand; PAM type: YTN; PAM sequence: CTG
gctttctttgaaatgttttc

SEQ ID NO: 306511 - DNA, 20 bp, Artificial Sequence
  Description of Artificial Sequence: Synthetic oligonucleotide
  Target: ATXN1; (+) strand; PAM type: YTN; PAM sequence: CTT
tctttgaaatgttttctcat

SEQ ID NO: 306512 - DNA, 20 bp, Artificial Sequence
  Description of Artificial Sequence: Synthetic oligonucleotide
  Target: ATXN1; (+) strand; PAM type: YTN; PAM sequence: TTT
ctttgaaatgttttctcatc

SEQ ID NO: 306513 - DNA, 20 bp, Artificial Sequence
  Description of Artificial Sequence: Synthetic oligonucleotide
  Target: ATXN1; (+) strand; PAM type: YTN; PAM sequence: TTC
tttgaaatgttttctcatct

SEQ ID NO: 306514 - DNA, 20 bp, Artificial Sequence
  Description of Artificial Sequence: Synthetic oligonucleotide
  Target: ATXN1; (+) strand; PAM type: YTN; PAM sequence: CTT
tgaaatgttttctcatctaa

SEQ ID NO: 306515 - DNA, 20 bp, Artificial Sequence
  Description of Artificial Sequence: Synthetic oligonucleotide
  Target: ATXN1; (+) strand; PAM type: YTN; PAM sequence: TTT
gaaatgttttctcatctaaa

SEQ ID NO: 306516 - DNA, 20 bp, Artificial Sequence
  Description of Artificial Sequence: Synthetic oligonucleotide
  Target: ATXN1; (+) strand; PAM type: YTN; PAM sequence: TTG
aaatgttttctcatctaaac

SEQ ID NO: 306517 - DNA, 20 bp, Artificial Sequence
  Description of Artificial Sequence: Synthetic oligonucleotide
  Target: ATXN1; (+) strand; PAM type: YTN; PAM sequence: TTT
tctcatctaaacttgggagc

SEQ ID NO: 306518 - DNA, 20 bp, Artificial Sequence
  Description of Artificial Sequence: Synthetic oligonucleotide
  Target: ATXN1; (+) strand; PAM type: YTN; PAM sequence: TTT
ctcatctaaacttgggagct

SEQ ID NO: 306519 - DNA, 20 bp, Artificial Sequence
  Description of Artificial Sequence: Synthetic oligonucleotide
  Target: ATXN1; (+) strand; PAM type: YTN; PAM sequence: TTC
tcatctaaacttgggagctg

SEQ ID NO: 306520 - DNA, 20 bp, Artificial Sequence
  Description of Artificial Sequence: Synthetic oligonucleotide
  Target: ATXN1; (+) strand; PAM type: YTN; PAM sequence: CTC
atctaaacttgggagctgct

SEQ ID NO: 306521 - DNA, 20 bp, Artificial Sequence
  Description of Artificial Sequence: Synthetic oligonucleotide
  Target: ATXN1; (+) strand; PAM type: YTN; PAM sequence: CTA
aacttgggagctgctggctt

SEQ ID NO: 306522 - DNA, 20 bp, Artificial Sequence
  Description of Artificial Sequence: Synthetic oligonucleotide
  Target: ATXN1; (+) strand; PAM type: YTN; PAM sequence: CTT
gggagctgctggctttgtat

SEQ ID NO: 306523 - DNA, 20 bp, Artificial Sequence
  Description of Artificial Sequence: Synthetic oligonucleotide
  Target: ATXN1; (+) strand; PAM type: YTN; PAM sequence: TTG
ggagctgctggctttgtatt

SEQ ID NO: 306524 - DNA, 20 bp, Artificial Sequence
  Description of Artificial Sequence: Synthetic oligonucleotide
  Target: ATXN1; (+) strand; PAM type: YTN; PAM sequence: CTG
ctggctttgtatttactcac

SEQ ID NO: 306525 - DNA, 20 bp, Artificial Sequence
  Description of Artificial Sequence: Synthetic oligonucleotide
  Target: ATXN1; (+) strand; PAM type: YTN; PAM sequence: CTG
gctttgtatttactcaccct

SEQ ID NO: 306526 - DNA, 20 bp, Artificial Sequence
  Description of Artificial Sequence: Synthetic oligonucleotide
  Target: ATXN1; (+) strand; PAM type: YTN; PAM sequence: CTT
tgtatttactcaccctgaaa

SEQ ID NO: 306527 - DNA, 20 bp, Artificial Sequence
  Description of Artificial Sequence: Synthetic oligonucleotide
  Target: ATXN1; (+) strand; PAM type: YTN; PAM sequence: TTT
gtatttactcaccctgaaac

SEQ ID NO: 306528 - DNA, 20 bp, Artificial Sequence
  Description of Artificial Sequence: Synthetic oligonucleotide
  Target: ATXN1; (+) strand; PAM type: YTN; PAM sequence: TTG
tatttactcaccctgaaact

SEQ ID NO: 306529 - DNA, 20 bp, Artificial Sequence
  Description of Artificial Sequence: Synthetic oligonucleotide
  Target: ATXN1; (+) strand; PAM type: YTN; PAM sequence: TTT
actcaccctgaaactgcatc

SEQ ID NO: 306530 - DNA, 20 bp, Artificial Sequence
  Description of Artificial Sequence: Synthetic oligonucleotide
  Target: ATXN1; (+) strand; PAM type: YTN; PAM sequence: TTA
ctcaccctgaaactgcatct

SEQ ID NO: 306531 - DNA, 20 bp, Artificial Sequence
  Description of Artificial Sequence: Synthetic oligonucleotide
  Target: ATXN1; (+) strand; PAM type: YTN; PAM sequence: CTC
accctgaaactgcatctggg

SEQ ID NO: 306532 - DNA, 20 bp, Artificial Sequence
  Description of Artificial Sequence: Synthetic oligonucleotide
  Target: ATXN1; (+) strand; PAM type: YTN; PAM sequence: CTG
aaactgcatctgggactccg

SEQ ID NO: 306533 - DNA, 20 bp, Artificial Sequence
  Description of Artificial Sequence: Synthetic oligonucleotide
  Target: ATXN1; (+) strand; PAM type: YTN; PAM sequence: CTG
catctgggactccggagtca

SEQ ID NO: 306534 - DNA, 20 bp, Artificial Sequence
  Description of Artificial Sequence: Synthetic oligonucleotide
  Target: ATXN1; (+) strand; PAM type: YTN; PAM sequence: CTG
ggactccggagtcaagctct

SEQ ID NO: 306535 - DNA, 20 bp, Artificial Sequence
  Description of Artificial Sequence: Synthetic oligonucleotide
  Target: ATXN1; (+) strand; PAM type: YTN; PAM sequence: CTC
cggagtcaagctctgaataa

SEQ ID NO: 306536 - DNA, 20 bp, Artificial Sequence
  Description of Artificial Sequence: Synthetic oligonucleotide
  Target: ATXN1; (+) strand; PAM type: YTN; PAM sequence: CTC
tgaataacattcaaagcctg

SEQ ID NO: 306537 - DNA, 20 bp, Artificial Sequence
  Description of Artificial Sequence: Synthetic oligonucleotide
  Target: ATXN1; (+) strand; PAM type: YTN; PAM sequence: CTG
aataacattcaaagcctgta

SEQ ID NO: 306538 - DNA, 20 bp, Artificial Sequence
  Description of Artificial Sequence: Synthetic oligonucleotide
  Target: ATXN1; (+) strand; PAM type: YTN; PAM sequence: TTC
aaagcctgtattctttcgtt

SEQ ID NO: 306539 - DNA, 20 bp, Artificial Sequence
  Description of Artificial Sequence: Synthetic oligonucleotide
  Target: ATXN1; (+) strand; PAM type: YTN; PAM sequence: CTG
tattctttcgttcgaatttt

SEQ ID NO: 306540 - DNA, 20 bp, Artificial Sequence
  Description of Artificial Sequence: Synthetic oligonucleotide
  Target: ATXN1; (+) strand; PAM type: YTN; PAM sequence: TTC
tttcgttcgaattttaggca

SEQ ID NO: 306541 - DNA, 20 bp, Artificial Sequence
  Description of Artificial Sequence: Synthetic oligonucleotide
  Target: ATXN1; (+) strand; PAM type: YTN; PAM sequence: CTT
tcgttcgaattttaggcatt

SEQ ID NO: 306542 - DNA, 20 bp, Artificial Sequence
  Description of Artificial Sequence: Synthetic oligonucleotide
  Target: ATXN1; (+) strand; PAM type: YTN; PAM sequence: TTT
cgttcgaattttaggcattg

SEQ ID NO: 306543 - DNA, 20 bp, Artificial Sequence
  Description of Artificial Sequence: Synthetic oligonucleotide
  Target: ATXN1; (+) strand; PAM type: YTN; PAM sequence: TTC
gttcgaattttaggcattgc

SEQ ID NO: 306544 - DNA, 20 bp, Artificial Sequence
  Description of Artificial Sequence: Synthetic oligonucleotide
  Target: ATXN1; (+) strand; PAM type: YTN; PAM sequence: TTC
gaattttaggcattgcaact

SEQ ID NO: 306545 - DNA, 20 bp, Artificial Sequence
  Description of Artificial Sequence: Synthetic oligonucleotide
  Target: ATXN1; (+) strand; PAM type: YTN; PAM sequence: TTT
taggcattgcaacttgtcat

SEQ ID NO: 306546 - DNA, 20 bp, Artificial Sequence
  Description of Artificial Sequence: Synthetic oligonucleotide
  Target: ATXN1; (+) strand; PAM type: YTN; PAM sequence: TTT
aggcattgcaacttgtcata

SEQ ID NO: 306547 - DNA, 20 bp, Artificial Sequence
  Description of Artificial Sequence: Synthetic oligonucleotide
  Target: ATXN1; (+) strand; PAM type: YTN; PAM sequence: TTA
ggcattgcaacttgtcatac

SEQ ID NO: 306548 - DNA, 20 bp, Artificial Sequence
  Description of Artificial Sequence: Synthetic oligonucleotide
  Target: ATXN1; (+) strand; PAM type: YTN; PAM sequence: TTG
caacttgtcatacctatgtc

SEQ ID NO: 306549 - DNA, 20 bp, Artificial Sequence
  Description of Artificial Sequence: Synthetic oligonucleotide
  Target: ATXN1; (+) strand; PAM type: YTN; PAM sequence: CTT
gtcatacctatgtcttttac

SEQ ID NO: 306550 - DNA, 20 bp, Artificial Sequence
  Description of Artificial Sequence: Synthetic oligonucleotide
  Target: ATXN1; (+) strand; PAM type: YTN; PAM sequence: TTG
tcatacctatgtcttttaca

SEQ ID NO: 306551 - DNA, 20 bp, Artificial Sequence
  Description of Artificial Sequence: Synthetic oligonucleotide
  Target: ATXN1; (+) strand; PAM type: YTN; PAM sequence: CTA
tgtcttttacagcaatgcaa

SEQ ID NO: 306552 - DNA, 20 bp, Artificial Sequence
  Description of Artificial Sequence: Synthetic oligonucleotide
  Target: ATXN1; (+) strand; PAM type: YTN; PAM sequence: CTT
ttacagcaatgcaacttaaa

SEQ ID NO: 306553 - DNA, 20 bp, Artificial Sequence
  Description of Artificial Sequence: Synthetic oligonucleotide
  Target: ATXN1; (+) strand; PAM type: YTN; PAM sequence: TTT
tacagcaatgcaacttaaat

SEQ ID NO: 306554 - DNA, 20 bp, Artificial Sequence
  Description of Artificial Sequence: Synthetic oligonucleotide
  Target: ATXN1; (+) strand; PAM type: YTN; PAM sequence: TTT
acagcaatgcaacttaaatg

SEQ ID NO: 306555 - DNA, 20 bp, Artificial Sequence
  Description of Artificial Sequence: Synthetic oligonucleotide
  Target: ATXN1; (+) strand; PAM type: YTN; PAM sequence: TTA
cagcaatgcaacttaaatga

SEQ ID NO: 306556 - DNA, 20 bp, Artificial Sequence
  Description of Artificial Sequence: Synthetic oligonucleotide
  Target: ATXN1; (+) strand; PAM type: YTN; PAM sequence: CTT
aaatgaggcaataactgaaa

SEQ ID NO: 306557 - DNA, 20 bp, Artificial Sequence
  Description of Artificial Sequence: Synthetic oligonucleotide
  Target: ATXN1; (+) strand; PAM type: YTN; PAM sequence: TTA
aatgaggcaataactgaaat

SEQ ID NO: 306558 - DNA, 20 bp, Artificial Sequence
  Description of Artificial Sequence: Synthetic oligonucleotide
  Target: ATXN1; (+) strand; PAM type: YTN; PAM sequence: CTG
aaatggcttaaccagggaga

SEQ ID NO: 306559 - DNA, 20 bp, Artificial Sequence
  Description of Artificial Sequence: Synthetic oligonucleotide
  Target: ATXN1; (+) strand; PAM type: YTN; PAM sequence: CTT
aaccagggagatgtggttta

SEQ ID NO: 306560 - DNA, 20 bp, Artificial Sequence
  Description of Artificial Sequence: Synthetic oligonucleotide
  Target: ATXN1; (+) strand; PAM type: YTN; PAM sequence: TTA
accagggagatgtggtttag

SEQ ID NO: 306561 - DNA, 20 bp, Artificial Sequence
  Description of Artificial Sequence: Synthetic oligonucleotide
  Target: ATXN1; (+) strand; PAM type: YTN; PAM sequence: TTT
agcaccatgttgcaatccag

SEQ ID NO: 306562 - DNA, 20 bp, Artificial Sequence
  Description of Artificial Sequence: Synthetic oligonucleotide
  Target: ATXN1; (+) strand; PAM type: YTN; PAM sequence: TTA
gcaccatgttgcaatccagc

SEQ ID NO: 306563 - DNA, 20 bp, Artificial Sequence
  Description of Artificial Sequence: Synthetic oligonucleotide
  Target: ATXN1; (+) strand; PAM type: YTN; PAM sequence: TTG
caatccagccatccaaccct

SEQ ID NO: 306564 - DNA, 20 bp, Artificial Sequence
  Description of Artificial Sequence: Synthetic oligonucleotide
  Target: ATXN1; (+) strand; PAM type: YTN; PAM sequence: CTC
atggaggtctctgagttggg

SEQ ID NO: 306565 - DNA, 20 bp, Artificial Sequence
  Description of Artificial Sequence: Synthetic oligonucleotide
  Target: ATXN1; (+) strand; PAM type: YTN; PAM sequence: CTC
tgagttgggggaacctacca

SEQ ID NO: 306566 - DNA, 20 bp, Artificial Sequence
  Description of Artificial Sequence: Synthetic oligonucleotide
  Target: ATXN1; (+) strand; PAM type: YTN; PAM sequence: CTG
agttgggggaacctaccaac

SEQ ID NO: 306567 - DNA, 20 bp, Artificial Sequence
  Description of Artificial Sequence: Synthetic oligonucleotide
  Target: ATXN1; (+) strand; PAM type: YTN; PAM sequence: TTG
ggggaacctaccaacaactg

SEQ ID NO: 306568 - DNA, 20 bp, Artificial Sequence
  Description of Artificial Sequence: Synthetic oligonucleotide
  Target: ATXN1; (+) strand; PAM type: YTN; PAM sequence: CTA
ccaacaactggtttactgag

SEQ ID NO: 306569 - DNA, 20 bp, Artificial Sequence
  Description of Artificial Sequence: Synthetic oligonucleotide
  Target: ATXN1; (+) strand; PAM type: YTN; PAM sequence: CTG
gtttactgagatctcacagc

SEQ ID NO: 306570 - DNA, 20 bp, Artificial Sequence
  Description of Artificial Sequence: Synthetic oligonucleotide
  Target: ATXN1; (+) strand; PAM type: YTN; PAM sequence: TTT
actgagatctcacagcccac

SEQ ID NO: 306571 - DNA, 20 bp, Artificial Sequence
  Description of Artificial Sequence: Synthetic oligonucleotide
  Target: ATXN1; (+) strand; PAM type: YTN; PAM sequence: TTA
ctgagatctcacagcccaca

SEQ ID NO: 306572 - DNA, 20 bp, Artificial Sequence
  Description of Artificial Sequence: Synthetic oligonucleotide
  Target: ATXN1; (+) strand; PAM type: YTN; PAM sequence: CTG
agatctcacagcccacacta

SEQ ID NO: 306573 - DNA, 20 bp, Artificial Sequence
  Description of Artificial Sequence: Synthetic oligonucleotide
  Target: ATXN1; (+) strand; PAM type: YTN; PAM sequence: CTC
acagcccacactatgatgct

SEQ ID NO: 306574 - DNA, 20 bp, Artificial Sequence
  Description of Artificial Sequence: Synthetic oligonucleotide
  Target: ATXN1; (+) strand; PAM type: YTN; PAM sequence: CTA
tgatgctttgggtgccacta

SEQ ID NO: 306575 - DNA, 20 bp, Artificial Sequence
  Description of Artificial Sequence: Synthetic oligonucleotide
  Target: ATXN1; (+) strand; PAM type: YTN; PAM sequence: CTT
tgggtgccactaactaaaag

SEQ ID NO: 306576 - DNA, 20 bp, Artificial Sequence
  Description of Artificial Sequence: Synthetic oligonucleotide
  Target: ATXN1; (+) strand; PAM type: YTN; PAM sequence: TTT
gggtgccactaactaaaagg

SEQ ID NO: 306577 - DNA, 20 bp, Artificial Sequence
  Description of Artificial Sequence: Synthetic oligonucleotide
  Target: ATXN1; (+) strand; PAM type: YTN; PAM sequence: TTG
ggtgccactaactaaaaggt

SEQ ID NO: 306578 - DNA, 20 bp, Artificial Sequence
  Description of Artificial Sequence: Synthetic oligonucleotide
  Target: ATXN1; (+) strand; PAM type: YTN; PAM sequence: CTA
actaaaaggtccctcttttt

SEQ ID NO: 306579 - DNA, 20 bp, Artificial Sequence
  Description of Artificial Sequence: Synthetic oligonucleotide
  Target: ATXN1; (+) strand; PAM type: YTN; PAM sequence: CTA
aaaggtccctctttttaatt

SEQ ID NO: 306580 - DNA, 20 bp, Artificial Sequence
  Description of Artificial Sequence: Synthetic oligonucleotide
  Target: ATXN1; (+) strand; PAM type: YTN; PAM sequence: CTC
tttttaattatctattgcaa

SEQ ID NO: 306581 - DNA, 20 bp, Artificial Sequence
  Description of Artificial Sequence: Synthetic oligonucleotide
  Target: ATXN1; (+) strand; PAM type: YTN; PAM sequence: CTT
tttaattatctattgcaacg

SEQ ID NO: 306582 - DNA, 20 bp, Artificial Sequence
  Description of Artificial Sequence: Synthetic oligonucleotide
  Target: ATXN1; (+) strand; PAM type: YTN; PAM sequence: TTT
ttaattatctattgcaacgg

SEQ ID NO: 306583 - DNA, 20 bp, Artificial Sequence
  Description of Artificial Sequence: Synthetic oligonucleotide
  Target: ATXN1; (+) strand; PAM type: YTN; PAM sequence: TTT
taattatctattgcaacggt

SEQ ID NO: 306584 - DNA, 20 bp, Artificial Sequence
  Description of Artificial Sequence: Synthetic oligonucleotide
  Target: ATXN1; (+) strand; PAM type: YTN; PAM sequence: TTT
aattatctattgcaacggtt

SEQ ID NO: 306585 - DNA, 20 bp, Artificial Sequence
  Description of Artificial Sequence: Synthetic oligonucleotide
  Target: ATXN1; (+) strand; PAM type: YTN; PAM sequence: TTA
attatctattgcaacggtta

SEQ ID NO: 306586 - DNA, 20 bp, Artificial Sequence
  Description of Artificial Sequence: Synthetic oligonucleotide
  Target: ATXN1; (+) strand; PAM type: YTN; PAM sequence: TTA
tctattgcaacggttatatt

SEQ ID NO: 306587 - DNA, 20 bp, Artificial Sequence
  Description of Artificial Sequence: Synthetic oligonucleotide
  Target: ATXN1; (+) strand; PAM type: YTN; PAM sequence: CTA
ttgcaacggttatatttttg

SEQ ID NO: 306588 - DNA, 20 bp, Artificial Sequence
  Description of Artificial Sequence: Synthetic oligonucleotide
  Target: ATXN1; (+) strand; PAM type: YTN; PAM sequence: TTG
caacggttatatttttgttc

SEQ ID NO: 306589 - DNA, 20 bp, Artificial Sequence
  Description of Artificial Sequence: Synthetic oligonucleotide
  Target: ATXN1; (+) strand; PAM type: YTN; PAM sequence: TTA
tatttttgttctatggattc

SEQ ID NO: 306590 - DNA, 20 bp, Artificial Sequence
  Description of Artificial Sequence: Synthetic oligonucleotide
  Target: ATXN1; (+) strand; PAM type: YTN; PAM sequence: TTT
ttgttctatggattctggcc

SEQ ID NO: 306591 - DNA, 20 bp, Artificial Sequence
  Description of Artificial Sequence: Synthetic oligonucleotide
  Target: ATXN1; (+) strand; PAM type: YTN; PAM sequence: TTT
tgttctatggattctggccc

SEQ ID NO: 306592 - DNA, 20 bp, Artificial Sequence
  Description of Artificial Sequence: Synthetic oligonucleotide
  Target: ATXN1; (+) strand; PAM type: YTN; PAM sequence: TTT
gttctatggattctggccct

SEQ ID NO: 306593 - DNA, 20 bp, Artificial Sequence
  Description of Artificial Sequence: Synthetic oligonucleotide
  Target: ATXN1; (+) strand; PAM type: YTN; PAM sequence: TTG
ttctatggattctggccctc

SEQ ID NO: 306594 - DNA, 20 bp, Artificial Sequence
  Description of Artificial Sequence: Synthetic oligonucleotide
  Target: ATXN1; (+) strand; PAM type: YTN; PAM sequence: TTC
tatggattctggccctccca

SEQ ID NO: 306595 - DNA, 20 bp, Artificial Sequence
  Description of Artificial Sequence: Synthetic oligonucleotide
  Target: ATXN1; (+) strand; PAM type: YTN; PAM sequence: CTA
tggattctggccctcccacc

SEQ ID NO: 306596 - DNA, 20 bp, Artificial Sequence
  Description of Artificial Sequence: Synthetic oligonucleotide
  Target: ATXN1; (+) strand; PAM type: YTN; PAM sequence: TTC
tggccctcccacctgattcc

SEQ ID NO: 306597 - DNA, 20 bp, Artificial Sequence
  Description of Artificial Sequence: Synthetic oligonucleotide
  Target: ATXN1; (+) strand; PAM type: YTN; PAM sequence: CTG
gccctcccacctgattcctg

SEQ ID NO: 306598 - DNA, 20 bp, Artificial Sequence
  Description of Artificial Sequence: Synthetic oligonucleotide
  Target: ATXN1; (+) strand; PAM type: YTN; PAM sequence: CTC
ccacctgattcctgacacag

SEQ ID NO: 306599 - DNA, 20 bp, Artificial Sequence
  Description of Artificial Sequence: Synthetic oligonucleotide
  Target: ATXN1; (+) strand; PAM type: YTN; PAM sequence: CTG
attcctgacacagagaaaat

SEQ ID NO: 306600 - DNA, 20 bp, Artificial Sequence
  Description of Artificial Sequence: Synthetic oligonucleotide
  Target: ATXN1; (+) strand; PAM type: YTN; PAM sequence: TTC
ctgacacagagaaaatggcc

SEQ ID NO: 306601 - DNA, 20 bp, Artificial Sequence
  Description of Artificial Sequence: Synthetic oligonucleotide
  Target: ATXN1; (+) strand; PAM type: YTN; PAM sequence: CTG
acacagagaaaatggccctc

SEQ ID NO: 306602 - DNA, 20 bp, Artificial Sequence
  Description of Artificial Sequence: Synthetic oligonucleotide
  Target: ATXN1; (+) strand; PAM type: YTN; PAM sequence: CTC
tgaacatcagtcacgtaggg

SEQ ID NO: 306603 - DNA, 20 bp, Artificial Sequence
  Description of Artificial Sequence: Synthetic oligonucleotide
  Target: ATXN1; (+) strand; PAM type: YTN; PAM sequence: CTG
aacatcagtcacgtagggta

SEQ ID NO: 306604 - DNA, 20 bp, Artificial Sequence
  Description of Artificial Sequence: Synthetic oligonucleotide
  Target: ATXN1; (+) strand; PAM type: YTN; PAM sequence: CTT
aaggactaagtgcttagcag

SEQ ID NO: 306605 - DNA, 20 bp, Artificial Sequence
  Description of Artificial Sequence: Synthetic oligonucleotide
  Target: ATXN1; (+) strand; PAM type: YTN; PAM sequence: TTA
aggactaagtgcttagcagt

SEQ ID NO: 306606 - DNA, 20 bp, Artificial Sequence
  Description of Artificial Sequence: Synthetic oligonucleotide
  Target: ATXN1; (+) strand; PAM type: YTN; PAM sequence: CTA
agtgcttagcagtctgtttg

SEQ ID NO: 306607 - DNA, 20 bp, Artificial Sequence
  Description of Artificial Sequence: Synthetic oligonucleotide
  Target: ATXN1; (+) strand; PAM type: YTN; PAM sequence: CTT
agcagtctgtttggcacaca

SEQ ID NO: 306608 - DNA, 20 bp, Artificial Sequence
  Description of Artificial Sequence: Synthetic oligonucleotide
  Target: ATXN1; (+) strand; PAM type: YTN; PAM sequence: TTA
gcagtctgtttggcacacag

SEQ ID NO: 306609 - DNA, 20 bp, Artificial Sequence
  Description of Artificial Sequence: Synthetic oligonucleotide
  Target: ATXN1; (+) strand; PAM type: YTN; PAM sequence: CTG
tttggcacacagtaggtgct

SEQ ID NO: 306610 - DNA, 20 bp, Artificial Sequence
  Description of Artificial Sequence: Synthetic oligonucleotide
  Target: ATXN1; (+) strand; PAM type: YTN; PAM sequence: TTT
ggcacacagtaggtgctcaa

SEQ ID NO: 306611 - DNA, 20 bp, Artificial Sequence
  Description of Artificial Sequence: Synthetic oligonucleotide
  Target: ATXN1; (+) strand; PAM type: YTN; PAM sequence: TTG
gcacacagtaggtgctcaat

SEQ ID NO: 306612 - DNA, 20 bp, Artificial Sequence
  Description of Artificial Sequence: Synthetic oligonucleotide
  Target: ATXN1; (+) strand; PAM type: YTN; PAM sequence: CTC
aataaatgttgattaccttt

SEQ ID NO: 306613 - DNA, 20 bp, Artificial Sequence
  Description of Artificial Sequence: Synthetic oligonucleotide
  Target: ATXN1; (+) strand; PAM type: YTN; PAM sequence: TTG
attacctttcttcctttttc

SEQ ID NO: 306614 - DNA, 20 bp, Artificial Sequence
  Description of Artificial Sequence: Synthetic oligonucleotide
  Target: ATXN1; (+) strand; PAM type: YTN; PAM sequence: TTA
cctttcttcctttttcccca

SEQ ID NO: 306615 - DNA, 20 bp, Artificial Sequence
  Description of Artificial Sequence: Synthetic oligonucleotide
  Target: ATXN1; (+) strand; PAM type: YTN; PAM sequence: CTT
tcttcctttttccccaaatg

SEQ ID NO: 306616 - DNA, 20 bp, Artificial Sequence
  Description of Artificial Sequence: Synthetic oligonucleotide
  Target: ATXN1; (+) strand; PAM type: YTN; PAM sequence: TTT
cttcctttttccccaaatga

SEQ ID NO: 306617 - DNA, 20 bp, Artificial Sequence
  Description of Artificial Sequence: Synthetic oligonucleotide
  Target: ATXN1; (+) strand; PAM type: YTN; PAM sequence: TTC
ttcctttttccccaaatgaa

SEQ ID NO: 306618 - DNA, 20 bp, Artificial Sequence
  Description of Artificial Sequence: Synthetic oligonucleotide
  Target: ATXN1; (+) strand; PAM type: YTN; PAM sequence: CTT
cctttttccccaaatgaatg

SEQ ID NO: 306619 - DNA, 20 bp, Artificial Sequence
  Description of Artificial Sequence: Synthetic oligonucleotide
  Target: ATXN1; (+) strand; PAM type: YTN; PAM sequence: TTC
ctttttccccaaatgaatga

SEQ ID NO: 306620 - DNA, 20 bp, Artificial Sequence
  Description of Artificial Sequence: Synthetic oligonucleotide
  Target: ATXN1; (+) strand; PAM type: YTN; PAM sequence: CTT
tttccccaaatgaatgaaaa

SEQ ID NO: 306621 - DNA, 20 bp, Artificial Sequence
  Description of Artificial Sequence: Synthetic oligonucleotide
  Target: ATXN1; (+) strand; PAM type: YTN; PAM sequence: TTT
ttccccaaatgaatgaaaaa

SEQ ID NO: 306622 - DNA, 20 bp, Artificial Sequence
  Description of Artificial Sequence: Synthetic oligonucleotide
  Target: ATXN1; (+) strand; PAM type: YTN; PAM sequence: TTT
tccccaaatgaatgaaaaac

SEQ ID NO: 306623 - DNA, 20 bp, Artificial Sequence
  Description of Artificial Sequence: Synthetic oligonucleotide
  Target: ATXN1; (+) strand; PAM type: YTN; PAM sequence: TTT
ccccaaatgaatgaaaaacc

SEQ ID NO: 306624 - DNA, 20 bp, Artificial Sequence
  Description of Artificial Sequence: Synthetic oligonucleotide
  Target: ATXN1; (+) strand; PAM type: YTN; PAM sequence: TTC
cccaaatgaatgaaaaacct

SEQ ID NO: 306625 - DNA, 20 bp, Artificial Sequence
  Description of Artificial Sequence: Synthetic oligonucleotide
  Target: ATXN1; (+) strand; PAM type: YTN; PAM sequence: CTC
tcatctcagagatggcaaca

SEQ ID NO: 306626 - DNA, 20 bp, Artificial Sequence
  Description of Artificial Sequence: Synthetic oligonucleotide
  Target: ATXN1; (+) strand; PAM type: YTN; PAM sequence: CTC
atctcagagatggcaacaga

SEQ ID NO: 306627 - DNA, 20 bp, Artificial Sequence
  Description of Artificial Sequence: Synthetic oligonucleotide
  Target: ATXN1; (+) strand; PAM type: YTN; PAM sequence: CTC
agagatggcaacagattaaa

SEQ ID NO: 306628 - DNA, 20 bp, Artificial Sequence
  Description of Artificial Sequence: Synthetic oligonucleotide
  Target: ATXN1; (+) strand; PAM type: YTN; PAM sequence: TTA
aaaaaagaaacttcaaaaat

SEQ ID NO: 306629 - DNA, 20 bp, Artificial Sequence
  Description of Artificial Sequence: Synthetic oligonucleotide
  Target: ATXN1; (+) strand; PAM type: YTN; PAM sequence: CTT
caaaaattggccaagcgcga

SEQ ID NO: 306630 - DNA, 20 bp, Artificial Sequence
  Description of Artificial Sequence: Synthetic oligonucleotide
  Target: ATXN1; (+) strand; PAM type: YTN; PAM sequence: TTC
aaaaattggccaagcgcgat

SEQ ID NO: 306631 - DNA, 20 bp, Artificial Sequence
  Description of Artificial Sequence: Synthetic oligonucleotide
  Target: ATXN1; (+) strand; PAM type: YTN; PAM sequence: TTG
gccaagcgcgatggcgcacg

SEQ ID NO: 306632 - DNA, 20 bp, Artificial Sequence
  Description of Artificial Sequence: Synthetic oligonucleotide
  Target: ATXN1; (+) strand; PAM type: YTN; PAM sequence: CTG
taatcccagcaatttgggag

SEQ ID NO: 306633 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcaggcaga

SEQ ID NO: 306634 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggcagat

SEQ ID NO: 306635 - DNA, 20 bp, Artificial Sequence
  Description of Artificial Sequence: Synthetic oligonucleotide
  Target: ATXN1; (+) strand; PAM type: YTN; PAM sequence: CTG
aggcaggcagatcacttgag

SEQ ID NO: 306636 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagttcaagacc

SEQ ID NO: 306637 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcaagacca

SEQ ID NO: 306638 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctgaccaacac

SEQ ID NO: 306639 - DNA, 20 bp, Artificial Sequence
  Description of Artificial Sequence: Synthetic oligonucleotide
  Target: ATXN1; (+) strand; PAM type: YTN; PAM sequence: CTG
accaacacggtgaaacccaa

SEQ ID NO: 306640 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 306641 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagt

SEQ ID NO: 306642 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagtcgg

SEQ ID NO: 306643 - DNA, 20 bp, Artificial Sequence
  Description of Artificial Sequence: Synthetic oligonucleotide
  Target: ATXN1; (+) strand; PAM type: YTN; PAM sequence: TTA
gtcgggcatggtggtgcacg

SEQ ID NO: 306644 - DNA, 20 bp, Artificial Sequence
  Description of Artificial Sequence: Synthetic oligonucleotide
  Target: ATXN1; (+) strand; PAM type: YTN; PAM sequence: CTG
tacagctactcaggaggctg

SEQ ID NO: 306645 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctggggcagga

SEQ ID NO: 306646 - DNA, 20 bp, Artificial Sequence
  Description of Artificial Sequence: Synthetic oligonucleotide
  Target: ATXN1; (+) strand; PAM type: YTN; PAM sequence: CTC
aggaggctggggcaggagaa

SEQ ID NO: 306647 - DNA, 20 bp, Artificial Sequence
  Description of Artificial Sequence: Synthetic oligonucleotide
  Target: ATXN1; (+) strand; PAM type: YTN; PAM sequence: CTG
gggcaggagaatcacctgaa

SEQ ID NO: 306648 - DNA, 20 bp, Artificial Sequence
  Description of Artificial Sequence: Synthetic oligonucleotide
  Target: ATXN1; (+) strand; PAM type: YTN; PAM sequence: CTG
aacccgggagatggacatta

SEQ ID NO: 306649 - DNA, 20 bp, Artificial Sequence
  Description of Artificial Sequence: Synthetic oligonucleotide
  Target: ATXN1; (+) strand; PAM type: YTN; PAM sequence: TTA
cagtgacgtgagattgtgcc

SEQ ID NO: 306650 - DNA, 20 bp, Artificial Sequence
  Description of Artificial Sequence: Synthetic oligonucleotide
  Target: ATXN1; (+) strand; PAM type: YTN; PAM sequence: TTG
tgccattgcaccccagcctg

SEQ ID NO: 306651 - DNA, 20 bp, Artificial Sequence
  Description of Artificial Sequence: Synthetic oligonucleotide
  Target: ATXN1; (+) strand; PAM type: YTN; PAM sequence: TTG
caccccagcctgggcaacag

SEQ ID NO: 306652 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagtgagtgaggc

SEQ ID NO: 306653 - DNA, 20 bp, Artificial Sequence
  Description of Artificial Sequence: Synthetic oligonucleotide
  Target: ATXN1; (+) strand; PAM type: YTN; PAM sequence: CTC
cgtcccaaaataaataaatt

SEQ ID NO: 306654 - DNA, 20 bp, Artificial Sequence
  Description of Artificial Sequence: Synthetic oligonucleotide
  Target: ATXN1; (+) strand; PAM type: YTN; PAM sequence: TTA
ataaatggaaatgaacaata

SEQ ID NO: 306655 - DNA, 20 bp, Artificial Sequence
  Description of Artificial Sequence: Synthetic oligonucleotide
  Target: ATXN1; (+) strand; PAM type: YTN; PAM sequence: CTT
ggaatttcctttataaaatt

SEQ ID NO: 306656 - DNA, 20 bp, Artificial Sequence
  Description of Artificial Sequence: Synthetic oligonucleotide
  Target: ATXN1; (+) strand; PAM type: YTN; PAM sequence: TTG
gaatttcctttataaaatta

SEQ ID NO: 306657 - DNA, 20 bp, Artificial Sequence
  Description of Artificial Sequence: Synthetic oligonucleotide
  Target: ATXN1; (+) strand; PAM type: YTN; PAM sequence: TTT
cctttataaaattagatgtc

SEQ ID NO: 306658 - DNA, 20 bp, Artificial Sequence
  Description of Artificial Sequence: Synthetic oligonucleotide
  Target: ATXN1; (+) strand; PAM type: YTN; PAM sequence: TTC
ctttataaaattagatgtct

SEQ ID NO: 306659 - DNA, 20 bp, Artificial Sequence
  Description of Artificial Sequence: Synthetic oligonucleotide
  Target: ATXN1; (+) strand; PAM type: YTN; PAM sequence: CTT
tataaaattagatgtctgca

SEQ ID NO: 306660 - DNA, 20 bp, Artificial Sequence
  Description of Artificial Sequence: Synthetic oligonucleotide
  Target: ATXN1; (+) strand; PAM type: YTN; PAM sequence: TTT
ataaaattagatgtctgcat

SEQ ID NO: 306661 - DNA, 20 bp, Artificial Sequence
  Description of Artificial Sequence: Synthetic oligonucleotide
  Target: ATXN1; (+) strand; PAM type: YTN; PAM sequence: TTA
taaaattagatgtctgcata

SEQ ID NO: 306662 - DNA, 20 bp, Artificial Sequence
  Description of Artificial Sequence: Synthetic oligonucleotide
  Target: ATXN1; (+) strand; PAM type: YTN; PAM sequence: TTA
gatgtctgcatattaaatga

SEQ ID NO: 306663 - DNA, 20 bp, Artificial Sequence
  Description of Artificial Sequence: Synthetic oligonucleotide
  Target: ATXN1; (+) strand; PAM type: YTN; PAM sequence: CTG
catattaaatgaagtttgtt

SEQ ID NO: 306664 - DNA, 20 bp, Artificial Sequence
  Description of Artificial Sequence: Synthetic oligonucleotide
  Target: ATXN1; (+) strand; PAM type: YTN; PAM sequence: TTA
aatgaagtttgttactgctt

SEQ ID NO: 306665 - DNA, 20 bp, Artificial Sequence
  Description of Artificial Sequence: Synthetic oligonucleotide
  Target: ATXN1; (+) strand; PAM type: YTN; PAM sequence: TTT
gttactgcttgattacaatt

SEQ ID NO: 306666 - DNA, 20 bp, Artificial Sequence
  Description of Artificial Sequence: Synthetic oligonucleotide
  Target: ATXN1; (+) strand; PAM type: YTN; PAM sequence: TTG
ttactgcttgattacaattt

SEQ ID NO: 306667 - DNA, 20 bp, Artificial Sequence
  Description of Artificial Sequence: Synthetic oligonucleotide
  Target: ATXN1; (+) strand; PAM type: YTN; PAM sequence: TTA
ctgcttgattacaatttaaa

SEQ ID NO: 306668 - DNA, 20 bp, Artificial Sequence
  Description of Artificial Sequence: Synthetic oligonucleotide
  Target: ATXN1; (+) strand; PAM type: YTN; PAM sequence: CTG
cttgattacaatttaaattc

SEQ ID NO: 306669 - DNA, 20 bp, Artificial Sequence
  Description of Artificial Sequence: Synthetic oligonucleotide
  Target: ATXN1; (+) strand; PAM type: YTN; PAM sequence: CTT
gattacaatttaaattcaag

SEQ ID NO: 306670 - DNA, 20 bp, Artificial Sequence
  Description of Artificial Sequence: Synthetic oligonucleotide
  Target: ATXN1; (+) strand; PAM type: YTN; PAM sequence: TTG
attacaatttaaattcaaga

SEQ ID NO: 306671 - DNA, 20 bp, Artificial Sequence
  Description of Artificial Sequence: Synthetic oligonucleotide
  Target: ATXN1; (+) strand; PAM type: YTN; PAM sequence: TTA
caatttaaattcaagattat

SEQ ID NO: 306672 - DNA, 20 bp, Artificial Sequence
  Description of Artificial Sequence: Synthetic oligonucleotide
  Target: ATXN1; (+) strand; PAM type: YTN; PAM sequence: TTT
aaattcaagattatcactaa

SEQ ID NO: 306673 - DNA, 20 bp, Artificial Sequence
  Description of Artificial Sequence: Synthetic oligonucleotide
  Target: ATXN1; (+) strand; PAM type: YTN; PAM sequence: TTA
aattcaagattatcactaaa

SEQ ID NO: 306674 - DNA, 20 bp, Artificial Sequence
  Description of Artificial Sequence: Synthetic oligonucleotide
  Target: ATXN1; (+) strand; PAM type: YTN; PAM sequence: TTC
aagattatcactaaaaatcc

SEQ ID NO: 306675 - DNA, 20 bp, Artificial Sequence
  Description of Artificial Sequence: Synthetic oligonucleotide
  Target: ATXN1; (+) strand; PAM type: YTN; PAM sequence: TTA
tcactaaaaatccctttata

SEQ ID NO: 306676 - DNA, 20 bp, Artificial Sequence
  Description of Artificial Sequence: Synthetic oligonucleotide
  Target: ATXN1; (+) strand; PAM type: YTN; PAM sequence: CTA
aaaatccctttataggtaga

SEQ ID NO: 306677 - DNA, 20 bp, Artificial Sequence
  Description of Artificial Sequence: Synthetic oligonucleotide
  Target: ATXN1; (+) strand; PAM type: YTN; PAM sequence: CTT
tataggtagaagttagggaa

SEQ ID NO: 306678 - DNA, 20 bp, Artificial Sequence
  Description of Artificial Sequence: Synthetic oligonucleotide
  Target: ATXN1; (+) strand; PAM type: YTN; PAM sequence: TTT
ataggtagaagttagggaaa

SEQ ID NO: 306679 - DNA, 20 bp, Artificial Sequence
  Description of Artificial Sequence: Synthetic oligonucleotide
  Target: ATXN1; (+) strand; PAM type: YTN; PAM sequence: TTA
taggtagaagttagggaaaa

SEQ ID NO: 306680 - DNA, 20 bp, Artificial Sequence
  Description of Artificial Sequence: Synthetic oligonucleotide
  Target: ATXN1; (+) strand; PAM type: YTN; PAM sequence: TTA
gggaaaaagatgtgtgaacg

SEQ ID NO: 306681 - DNA, 20 bp, Artificial Sequence
  Description of Artificial Sequence: Synthetic oligonucleotide
  Target: ATXN1; (+) strand; PAM type: YTN; PAM sequence: CTT
tctggagttaaagggtaaaa

SEQ ID NO: 306682 - DNA, 20 bp, Artificial Sequence
  Description of Artificial Sequence: Synthetic oligonucleotide
  Target: ATXN1; (+) strand; PAM type: YTN; PAM sequence: TTT
ctggagttaaagggtaaaac

SEQ ID NO: 306683 - DNA, 20 bp, Artificial Sequence
  Description of Artificial Sequence: Synthetic oligonucleotide
  Target: ATXN1; (+) strand; PAM type: YTN; PAM sequence: TTC
tggagttaaagggtaaaaca

SEQ ID NO: 306684 - DNA, 20 bp, Artificial Sequence
  Description of Artificial Sequence: Synthetic oligonucleotide
  Target: ATXN1; (+) strand; PAM type: YTN; PAM sequence: CTG
gagttaaagggtaaaacagt

SEQ ID NO: 306685 - DNA, 20 bp, Artificial Sequence
  Description of Artificial Sequence: Synthetic oligonucleotide
  Target: ATXN1; (+) strand; PAM type: YTN; PAM sequence: TTA
aagggtaaaacagtatgtat

SEQ ID NO: 306686 - DNA, 20 bp, Artificial Sequence
  Description of Artificial Sequence: Synthetic oligonucleotide
  Target: ATXN1; (+) strand; PAM type: YTN; PAM sequence: TTT
atacatatataatgtaatat

SEQ ID NO: 306687 - DNA, 20 bp, Artificial Sequence
  Description of Artificial Sequence: Synthetic oligonucleotide
  Target: ATXN1; (+) strand; PAM type: YTN; PAM sequence: TTA
tacatatataatgtaatata

SEQ ID NO: 306688 - DNA, 20 bp, Artificial Sequence
  Description of Artificial Sequence: Synthetic oligonucleotide
  Target: ATXN1; (+) strand; PAM type: YTN; PAM sequence: TTT
atgtacaataatatatttct

SEQ ID NO: 306689 - DNA, 20 bp, Artificial Sequence
  Description of Artificial Sequence: Synthetic oligonucleotide
  Target: ATXN1; (+) strand; PAM type: YTN; PAM sequence: TTA
tgtacaataatatatttctt

SEQ ID NO: 306690 - DNA, 20 bp, Artificial Sequence
  Description of Artificial Sequence: Synthetic oligonucleotide
  Target: ATXN1; (+) strand; PAM type: YTN; PAM sequence: TTT
cttaattctacaaaatacag

SEQ ID NO: 306691 - DNA, 20 bp, Artificial Sequence
  Description of Artificial Sequence: Synthetic oligonucleotide
  Target: ATXN1; (+) strand; PAM type: YTN; PAM sequence: TTC
ttaattctacaaaatacaga

SEQ ID NO: 306692 - DNA, 20 bp, Artificial Sequence
  Description of Artificial Sequence: Synthetic oligonucleotide
  Target: ATXN1; (+) strand; PAM type: YTN; PAM sequence: CTT
aattctacaaaatacagaaa

SEQ ID NO: 306693 - DNA, 20 bp, Artificial Sequence
  Description of Artificial Sequence: Synthetic oligonucleotide
  Target: ATXN1; (+) strand; PAM type: YTN; PAM sequence: TTA
attctacaaaatacagaaag

SEQ ID NO: 306694 - DNA, 20 bp, Artificial Sequence
  Description of Artificial Sequence: Synthetic oligonucleotide
  Target: ATXN1; (+) strand; PAM type: YTN; PAM sequence: TTC
tacaaaatacagaaagaata

SEQ ID NO: 306695 - DNA, 20 bp, Artificial Sequence
  Description of Artificial Sequence: Synthetic oligonucleotide
  Target: ATXN1; (+) strand; PAM type: YTN; PAM sequence: CTA
caaaatacagaaagaatatt

SEQ ID NO: 306696 - DNA, 20 bp, Artificial Sequence
  Description of Artificial Sequence: Synthetic oligonucleotide
  Target: ATXN1; (+) strand; PAM type: YTN; PAM sequence: TTA
taagaaaatgtcccaccttc

SEQ ID NO: 306697 - DNA, 20 bp, Artificial Sequence
  Description of Artificial Sequence: Synthetic oligonucleotide
  Target: ATXN1; (+) strand; PAM type: YTN; PAM sequence: CTT
ccttaggaaccatgtgtacc

SEQ ID NO: 306698 - DNA, 20 bp, Artificial Sequence
  Description of Artificial Sequence: Synthetic oligonucleotide
  Target: ATXN1; (+) strand; PAM type: YTN; PAM sequence: TTC
cttaggaaccatgtgtacca

SEQ ID NO: 306699 - DNA, 20 bp, Artificial Sequence
  Description of Artificial Sequence: Synthetic oligonucleotide
  Target: ATXN1; (+) strand; PAM type: YTN; PAM sequence: CTT
aggaaccatgtgtaccaaga

SEQ ID NO: 306700 - DNA, 20 bp, Artificial Sequence
  Description of Artificial Sequence: Synthetic oligonucleotide
  Target: ATXN1; (+) strand; PAM type: YTN; PAM sequence: TTA
ggaaccatgtgtaccaagac

SEQ ID NO: 306701 - DNA, 20 bp, Artificial Sequence
  Description of Artificial Sequence: Synthetic oligonucleotide
  Target: ATXN1; (+) strand; PAM type: YTN; PAM sequence: CTT
tttaggaatagcaccctgcc

SEQ ID NO: 306702 - DNA, 20 bp, Artificial Sequence
  Description of Artificial Sequence: Synthetic oligonucleotide
  Target: ATXN1; (+) strand; PAM type: YTN; PAM sequence: TTT
ttaggaatagcaccctgcct

SEQ ID NO: 306703 - DNA, 20 bp, Artificial Sequence
  Description of Artificial Sequence: Synthetic oligonucleotide
  Target: ATXN1; (+) strand; PAM type: YTN; PAM sequence: TTT
taggaatagcaccctgcctg

SEQ ID NO: 306704 - DNA, 20 bp, Artificial Sequence
  Description of Artificial Sequence: Synthetic oligonucleotide
  Target: ATXN1; (+) strand; PAM type: YTN; PAM sequence: TTT
aggaatagcaccctgcctga

SEQ ID NO: 306705 - DNA, 20 bp, Artificial Sequence
  Description of Artificial Sequence: Synthetic oligonucleotide
  Target: ATXN1; (+) strand; PAM type: YTN; PAM sequence: TTA
ggaatagcaccctgcctgaa

SEQ ID NO: 306706 - DNA, 20 bp, Artificial Sequence
  Description of Artificial Sequence: Synthetic oligonucleotide
  Target: ATXN1; (+) strand; PAM type: YTN; PAM sequence: CTG
cctgaagattgtattcttgc

SEQ ID NO: 306707 - DNA, 20 bp, Artificial Sequence
  Description of Artificial Sequence: Synthetic oligonucleotide
  Target: ATXN1; (+) strand; PAM type: YTN; PAM sequence: CTG
aagattgtattcttgcccac

SEQ ID NO: 306708 - DNA, 20 bp, Artificial Sequence
  Description of Artificial Sequence: Synthetic oligonucleotide
  Target: ATXN1; (+) strand; PAM type: YTN; PAM sequence: TTG
tattcttgcccactgttctt

SEQ ID NO: 306709 - DNA, 20 bp, Artificial Sequence
  Description of Artificial Sequence: Synthetic oligonucleotide
  Target: ATXN1; (+) strand; PAM type: YTN; PAM sequence: TTC
ttgcccactgttctttccta

SEQ ID NO: 306710 - DNA, 20 bp, Artificial Sequence
  Description of Artificial Sequence: Synthetic oligonucleotide
  Target: ATXN1; (+) strand; PAM type: YTN; PAM sequence: CTT
gcccactgttctttcctaac

SEQ ID NO: 306711 - DNA, 20 bp, Artificial Sequence
  Description of Artificial Sequence: Synthetic oligonucleotide
  Target: ATXN1; (+) strand; PAM type: YTN; PAM sequence: TTG
cccactgttctttcctaaca

SEQ ID NO: 306712 - DNA, 20 bp, Artificial Sequence
  Description of Artificial Sequence: Synthetic oligonucleotide
  Target: ATXN1; (+) strand; PAM type: YTN; PAM sequence: CTG
ttctttcctaacaaaatttc

SEQ ID NO: 306713 - DNA, 20 bp, Artificial Sequence
  Description of Artificial Sequence: Synthetic oligonucleotide
  Target: ATXN1; (+) strand; PAM type: YTN; PAM sequence: TTC
tttcctaacaaaatttccct

SEQ ID NO: 306714 - DNA, 20 bp, Artificial Sequence
  Description of Artificial Sequence: Synthetic oligonucleotide
  Target: ATXN1; (+) strand; PAM type: YTN; PAM sequence: CTT
tcctaacaaaatttcccttc

SEQ ID NO: 306715 - DNA, 20 bp, Artificial Sequence
  Description of Artificial Sequence: Synthetic oligonucleotide
  Target: ATXN1; (+) strand; PAM type: YTN; PAM sequence: TTT
cctaacaaaatttcccttca

SEQ ID NO: 306716 - DNA, 20 bp, Artificial Sequence
  Description of Artificial Sequence: Synthetic oligonucleotide
  Target: ATXN1; (+) strand; PAM type: YTN; PAM sequence: TTC
ctaacaaaatttcccttcaa

SEQ ID NO: 306717 - DNA, 20 bp, Artificial Sequence
  Description of Artificial Sequence: Synthetic oligonucleotide
  Target: ATXN1; (+) strand; PAM type: YTN; PAM sequence: CTA
acaaaatttcccttcaagtt

SEQ ID NO: 306718 - DNA, 20 bp, Artificial Sequence
  Description of Artificial Sequence: Synthetic oligonucleotide
  Target: ATXN1; (+) strand; PAM type: YTN; PAM sequence: TTT
cccttcaagttctcctttcg

SEQ ID NO: 306719 - DNA, 20 bp, Artificial Sequence
  Description of Artificial Sequence: Synthetic oligonucleotide
  Target: ATXN1; (+) strand; PAM type: YTN; PAM sequence: TTC
ccttcaagttctcctttcgt

SEQ ID NO: 306720 - DNA, 20 bp, Artificial Sequence
  Description of Artificial Sequence: Synthetic oligonucleotide
  Target: ATXN1; (+) strand; PAM type: YTN; PAM sequence: CTT
caagttctcctttcgttgtg

SEQ ID NO: 306721 - DNA, 20 bp, Artificial Sequence
  Description of Artificial Sequence: Synthetic oligonucleotide
  Target: ATXN1; (+) strand; PAM type: YTN; PAM sequence: TTC
aagttctcctttcgttgtga

SEQ ID NO: 306722 - DNA, 20 bp, Artificial Sequence
  Description of Artificial Sequence: Synthetic oligonucleotide
  Target: ATXN1; (+) strand; PAM type: YTN; PAM sequence: TTC
tcctttcgttgtgaacttca

SEQ ID NO: 306723 - DNA, 20 bp, Artificial Sequence
  Description of Artificial Sequence: Synthetic oligonucleotide
  Target: ATXN1; (+) strand; PAM type: YTN; PAM sequence: CTC
ctttcgttgtgaacttcagt

SEQ ID NO: 306724 - DNA, 20 bp, Artificial Sequence
  Description of Artificial Sequence: Synthetic oligonucleotide
  Target: ATXN1; (+) strand; PAM type: YTN; PAM sequence: CTT
tcgttgtgaacttcagttat

SEQ ID NO: 306725 - DNA, 20 bp, Artificial Sequence
  Description of Artificial Sequence: Synthetic oligonucleotide
  Target: ATXN1; (+) strand; PAM type: YTN; PAM sequence: TTT
cgttgtgaacttcagttatt

SEQ ID NO: 306726 - DNA, 20 bp, Artificial Sequence
  Description of Artificial Sequence: Synthetic oligonucleotide
  Target: ATXN1; (+) strand; PAM type: YTN; PAM sequence: TTC
gttgtgaacttcagttattg

SEQ ID NO: 306727 - DNA, 20 bp, Artificial Sequence
  Description of Artificial Sequence: Synthetic oligonucleotide
  Target: ATXN1; (+) strand; PAM type: YTN; PAM sequence: TTG
tgaacttcagttattgcctt

SEQ ID NO: 306728 - DNA, 20 bp, Artificial Sequence
  Description of Artificial Sequence: Synthetic oligonucleotide
  Target: ATXN1; (+) strand; PAM type: YTN; PAM sequence: CTT
cagttattgcctttccactg

SEQ ID NO: 306729 - DNA, 20 bp, Artificial Sequence
  Description of Artificial Sequence: Synthetic oligonucleotide
  Target: ATXN1; (+) strand; PAM type: YTN; PAM sequence: TTC
agttattgcctttccactgg

SEQ ID NO: 306730 - DNA, 20 bp, Artificial Sequence
  Description of Artificial Sequence: Synthetic oligonucleotide
  Target: ATXN1; (+) strand; PAM type: YTN; PAM sequence: TTA
ttgcctttccactggctaaa

SEQ ID NO: 306731 - DNA, 20 bp, Artificial Sequence
  Description of Artificial Sequence: Synthetic oligonucleotide
  Target: ATXN1; (+) strand; PAM type: YTN; PAM sequence: TTG
cctttccactggctaaacac

SEQ ID NO: 306732 - DNA, 20 bp, Artificial Sequence
  Description of Artificial Sequence: Synthetic oligonucleotide
  Target: ATXN1; (+) strand; PAM type: YTN; PAM sequence: CTT
tccactggctaaacacaacc

SEQ ID NO: 306733 - DNA, 20 bp, Artificial Sequence
  Description of Artificial Sequence: Synthetic oligonucleotide
  Target: ATXN1; (+) strand; PAM type: YTN; PAM sequence: TTT
ccactggctaaacacaacca

SEQ ID NO: 306734 - DNA, 20 bp, Artificial Sequence
  Description of Artificial Sequence: Synthetic oligonucleotide
  Target: ATXN1; (+) strand; PAM type: YTN; PAM sequence: TTC
cactggctaaacacaaccac

SEQ ID NO: 306735 - DNA, 20 bp, Artificial Sequence
  Description of Artificial Sequence: Synthetic oligonucleotide
  Target: ATXN1; (+) strand; PAM type: YTN; PAM sequence: CTG
gctaaacacaaccacacata

SEQ ID NO: 306736 - DNA, 20 bp, Artificial Sequence
  Description of Artificial Sequence: Synthetic oligonucleotide
  Target: ATXN1; (+) strand; PAM type: YTN; PAM sequence: CTA
aacacaaccacacatatctt

SEQ ID NO: 306737 - DNA, 20 bp, Artificial Sequence
  Description of Artificial Sequence: Synthetic oligonucleotide
  Target: ATXN1; (+) strand; PAM type: YTN; PAM sequence: CTT
tcaaaagctaattgaagcat

SEQ ID NO: 306738 - DNA, 20 bp, Artificial Sequence
  Description of Artificial Sequence: Synthetic oligonucleotide
  Target: ATXN1; (+) strand; PAM type: YTN; PAM sequence: TTT
caaaagctaattgaagcata

SEQ ID NO: 306739 - DNA, 20 bp, Artificial Sequence
  Description of Artificial Sequence: Synthetic oligonucleotide
  Target: ATXN1; (+) strand; PAM type: YTN; PAM sequence: TTC
aaaagctaattgaagcataa

SEQ ID NO: 306740 - DNA, 20 bp, Artificial Sequence
  Description of Artificial Sequence: Synthetic oligonucleotide
  Target: ATXN1; (+) strand; PAM type: YTN; PAM sequence: CTA
attgaagcataaagaagtta

SEQ ID NO: 306741 - DNA, 20 bp, Artificial Sequence
  Description of Artificial Sequence: Synthetic oligonucleotide
  Target: ATXN1; (+) strand; PAM type: YTN; PAM sequence: TTG
aagcataaagaagttaaaca

SEQ ID NO: 306742 - DNA, 20 bp, Artificial Sequence
  Description of Artificial Sequence: Synthetic oligonucleotide
  Target: ATXN1; (+) strand; PAM type: YTN; PAM sequence: TTA
aacatgatttattccaggtc

SEQ ID NO: 306743 - DNA, 20 bp, Artificial Sequence
  Description of Artificial Sequence: Synthetic oligonucleotide
  Target: ATXN1; (+) strand; PAM type: YTN; PAM sequence: TTT
attccaggtcaaatttcaag

SEQ ID NO: 306744 - DNA, 20 bp, Artificial Sequence
  Description of Artificial Sequence: Synthetic oligonucleotide
  Target: ATXN1; (+) strand; PAM type: YTN; PAM sequence: TTA
ttccaggtcaaatttcaagt

SEQ ID NO: 306745 - DNA, 20 bp, Artificial Sequence
  Description of Artificial Sequence: Synthetic oligonucleotide
  Target: ATXN1; (+) strand; PAM type: YTN; PAM sequence: TTC
caggtcaaatttcaagtcag

SEQ ID NO: 306746 - DNA, 20 bp, Artificial Sequence
  Description of Artificial Sequence: Synthetic oligonucleotide
  Target: ATXN1; (+) strand; PAM type: YTN; PAM sequence: TTT
caagtcagtggaaaagccat

SEQ ID NO: 306747 - DNA, 20 bp, Artificial Sequence
  Description of Artificial Sequence: Synthetic oligonucleotide
  Target: ATXN1; (+) strand; PAM type: YTN; PAM sequence: TTC
aagtcagtggaaaagccata

SEQ ID NO: 306748 - DNA, 20 bp, Artificial Sequence
  Description of Artificial Sequence: Synthetic oligonucleotide
  Target: ATXN1; (+) strand; PAM type: YTN; PAM sequence: CTT
cctcttgctgagtgttctgg

SEQ ID NO: 306749 - DNA, 20 bp, Artificial Sequence
  Description of Artificial Sequence: Synthetic oligonucleotide
  Target: ATXN1; (+) strand; PAM type: YTN; PAM sequence: TTC
ctcttgctgagtgttctggg

SEQ ID NO: 306750 - DNA, 20 bp, Artificial Sequence
  Description of Artificial Sequence: Synthetic oligonucleotide
  Target: ATXN1; (+) strand; PAM type: YTN; PAM sequence: CTC
ttgctgagtgttctgggtgc

SEQ ID NO: 306751 - DNA, 20 bp, Artificial Sequence
  Description of Artificial Sequence: Synthetic oligonucleotide
  Target: ATXN1; (+) strand; PAM type: YTN; PAM sequence: CTT
gctgagtgttctgggtgccg

SEQ ID NO: 306752 - DNA, 20 bp, Artificial Sequence
  Description of Artificial Sequence: Synthetic oligonucleotide
  Target: ATXN1; (+) strand; PAM type: YTN; PAM sequence: TTG
ctgagtgttctgggtgccgg

SEQ ID NO: 306753 - DNA, 20 bp, Artificial Sequence
  Description of Artificial Sequence: Synthetic oligonucleotide
  Target: ATXN1; (+) strand; PAM type: YTN; PAM sequence: CTG
agtgttctgggtgccgggcc

SEQ ID NO: 306754 - DNA, 20 bp, Artificial Sequence
  Description of Artificial Sequence: Synthetic oligonucleotide
  Target: ATXN1; (+) strand; PAM type: YTN; PAM sequence: TTC
tgggtgccgggccatgctgc

SEQ ID NO: 306755 - DNA, 20 bp, Artificial Sequence
  Description of Artificial Sequence: Synthetic oligonucleotide
  Target: ATXN1; (+) strand; PAM type: YTN; PAM sequence: CTG
ggtgccgggccatgctgcag

SEQ ID NO: 306756 - DNA, 20 bp, Artificial Sequence
  Description of Artificial Sequence: Synthetic oligonucleotide
  Target: ATXN1; (+) strand; PAM type: YTN; PAM sequence: CTG
cagggtgaaattttgacttt

SEQ ID NO: 306757 - DNA, 20 bp, Artificial Sequence
  Description of Artificial Sequence: Synthetic oligonucleotide
  Target: ATXN1; (+) strand; PAM type: YTN; PAM sequence: TTT
tgacttttgattggtgtttt

SEQ ID NO: 306758 - DNA, 20 bp, Artificial Sequence
  Description of Artificial Sequence: Synthetic oligonucleotide
  Target: ATXN1; (+) strand; PAM type: YTN; PAM sequence: TTT
gacttttgattggtgttttc

SEQ ID NO: 306759 - DNA, 20 bp, Artificial Sequence
  Description of Artificial Sequence: Synthetic oligonucleotide
  Target: ATXN1; (+) strand; PAM type: YTN; PAM sequence: TTG
acttttgattggtgttttca

SEQ ID NO: 306760 - DNA, 20 bp, Artificial Sequence
  Description of Artificial Sequence: Synthetic oligonucleotide
  Target: ATXN1; (+) strand; PAM type: YTN; PAM sequence: CTT
ttgattggtgttttcaaaat

SEQ ID NO: 306761 - DNA, 20 bp, Artificial Sequence
  Description of Artificial Sequence: Synthetic oligonucleotide
  Target: ATXN1; (+) strand; PAM type: YTN; PAM sequence: TTT
tgattggtgttttcaaaatt

SEQ ID NO: 306762 - DNA, 20 bp, Artificial Sequence
  Description of Artificial Sequence: Synthetic oligonucleotide
  Target: ATXN1; (+) strand; PAM type: YTN; PAM sequence: TTT
gattggtgttttcaaaattc

SEQ ID NO: 306763 - DNA, 20 bp, Artificial Sequence
  Description of Artificial Sequence: Synthetic oligonucleotide
  Target: ATXN1; (+) strand; PAM type: YTN; PAM sequence: TTG
attggtgttttcaaaattcc

SEQ ID NO: 306764 - DNA, 20 bp, Artificial Sequence
  Description of Artificial Sequence: Synthetic oligonucleotide
  Target: ATXN1; (+) strand; PAM type: YTN; PAM sequence: TTG
gtgttttcaaaattcctttg

SEQ ID NO: 306765 - DNA, 20 bp, Artificial Sequence
  Description of Artificial Sequence: Synthetic oligonucleotide
  Target: ATXN1; (+) strand; PAM type: YTN; PAM sequence: TTT
tcaaaattcctttgtgtatt

SEQ ID NO: 306766 - DNA, 20 bp, Artificial Sequence
  Description of Artificial Sequence: Synthetic oligonucleotide
  Target: ATXN1; (+) strand; PAM type: YTN; PAM sequence: TTT
caaaattcctttgtgtattt

SEQ ID NO: 306767 - DNA, 20 bp, Artificial Sequence
  Description of Artificial Sequence: Synthetic oligonucleotide
  Target: ATXN1; (+) strand; PAM type: YTN; PAM sequence: TTC
aaaattcctttgtgtattta

SEQ ID NO: 306768 - DNA, 20 bp, Artificial Sequence
  Description of Artificial Sequence: Synthetic oligonucleotide
  Target: ATXN1; (+) strand; PAM type: YTN; PAM sequence: TTC
ctttgtgtatttaaaagtag

SEQ ID NO: 306769 - DNA, 20 bp, Artificial Sequence
  Description of Artificial Sequence: Synthetic oligonucleotide
  Target: ATXN1; (+) strand; PAM type: YTN; PAM sequence: CTT
tgtgtatttaaaagtagctc

SEQ ID NO: 306770 - DNA, 20 bp, Artificial Sequence
  Description of Artificial Sequence: Synthetic oligonucleotide
  Target: ATXN1; (+) strand; PAM type: YTN; PAM sequence: TTT
gtgtatttaaaagtagctca

SEQ ID NO: 306771 - DNA, 20 bp, Artificial Sequence
  Description of Artificial Sequence: Synthetic oligonucleotide
  Target: ATXN1; (+) strand; PAM type: YTN; PAM sequence: TTG
tgtatttaaaagtagctcat

SEQ ID NO: 306772 - DNA, 20 bp, Artificial Sequence
  Description of Artificial Sequence: Synthetic oligonucleotide
  Target: ATXN1; (+) strand; PAM type: YTN; PAM sequence: TTT
aaaagtagctcatattgaca

SEQ ID NO: 306773 - DNA, 20 bp, Artificial Sequence
  Description of Artificial Sequence: Synthetic oligonucleotide
  Target: ATXN1; (+) strand; PAM type: YTN; PAM sequence: TTA
aaagtagctcatattgacaa

SEQ ID NO: 306774 - DNA, 20 bp, Artificial Sequence
  Description of Artificial Sequence: Synthetic oligonucleotide
  Target: ATXN1; (+) strand; PAM type: YTN; PAM sequence: CTC
atattgacaagatagaagga

SEQ ID NO: 306775 - DNA, 20 bp, Artificial Sequence
  Description of Artificial Sequence: Synthetic oligonucleotide
  Target: ATXN1; (+) strand; PAM type: YTN; PAM sequence: TTG
acaagatagaaggaagaagc

SEQ ID NO: 306776 - DNA, 20 bp, Artificial Sequence
  Description of Artificial Sequence: Synthetic oligonucleotide
  Target: ATXN1; (+) strand; PAM type: YTN; PAM sequence: CTT
ggacaaatgtcattaacgtt

SEQ ID NO: 306777 - DNA, 20 bp, Artificial Sequence
  Description of Artificial Sequence: Synthetic oligonucleotide
  Target: ATXN1; (+) strand; PAM type: YTN; PAM sequence: TTG
gacaaatgtcattaacgttg

SEQ ID NO: 306778 - DNA, 20 bp, Artificial Sequence
  Description of Artificial Sequence: Synthetic oligonucleotide
  Target: ATXN1; (+) strand; PAM type: YTN; PAM sequence: TTA
acgttgcacaatttcacatt

SEQ ID NO: 306779 - DNA, 20 bp, Artificial Sequence
  Description of Artificial Sequence: Synthetic oligonucleotide
  Target: ATXN1; (+) strand; PAM type: YTN; PAM sequence: TTG
cacaatttcacattcctgga

SEQ ID NO: 306780 - DNA, 20 bp, Artificial Sequence
  Description of Artificial Sequence: Synthetic oligonucleotide
  Target: ATXN1; (+) strand; PAM type: YTN; PAM sequence: TTT
cacattcctggacctatcac

SEQ ID NO: 306781 - DNA, 20 bp, Artificial Sequence
  Description of Artificial Sequence: Synthetic oligonucleotide
  Target: ATXN1; (+) strand; PAM type: YTN; PAM sequence: TTC
acattcctggacctatcaca

SEQ ID NO: 306782 - DNA, 20 bp, Artificial Sequence
  Description of Artificial Sequence: Synthetic oligonucleotide
  Target: ATXN1; (+) strand; PAM type: YTN; PAM sequence: TTC
ctggacctatcacaggtgcc

SEQ ID NO: 306783 - DNA, 20 bp, Artificial Sequence
  Description of Artificial Sequence: Synthetic oligonucleotide
  Target: ATXN1; (+) strand; PAM type: YTN; PAM sequence: CTG
gacctatcacaggtgccact

SEQ ID NO: 306784 - DNA, 20 bp, Artificial Sequence
  Description of Artificial Sequence: Synthetic oligonucleotide
  Target: ATXN1; (+) strand; PAM type: YTN; PAM sequence: CTA
tcacaggtgccactggttat

SEQ ID NO: 306785 - DNA, 20 bp, Artificial Sequence
  Description of Artificial Sequence: Synthetic oligonucleotide
  Target: ATXN1; (+) strand; PAM type: YTN; PAM sequence: CTG
gttattaacatatgcatgta

SEQ ID NO: 306786 - DNA, 20 bp, Artificial Sequence
  Description of Artificial Sequence: Synthetic oligonucleotide
  Target: ATXN1; (+) strand; PAM type: YTN; PAM sequence: TTA
ttaacatatgcatgtaaaac

SEQ ID NO: 306787 - DNA, 20 bp, Artificial Sequence
  Description of Artificial Sequence: Synthetic oligonucleotide
  Target: ATXN1; (+) strand; PAM type: YTN; PAM sequence: TTA
acatatgcatgtaaaactcc

SEQ ID NO: 306788 - DNA, 20 bp, Artificial Sequence
  Description of Artificial Sequence: Synthetic oligonucleotide
  Target: ATXN1; (+) strand; PAM type: YTN; PAM sequence: CTC
cctgaaagacactgtataac

SEQ ID NO: 306789 - DNA, 20 bp, Artificial Sequence
  Description of Artificial Sequence: Synthetic oligonucleotide
  Target: ATXN1; (+) strand; PAM type: YTN; PAM sequence: CTG
aaagacactgtataactggc

SEQ ID NO: 306790 - DNA, 20 bp, Artificial Sequence
  Description of Artificial Sequence: Synthetic oligonucleotide
  Target: ATXN1; (+) strand; PAM type: YTN; PAM sequence: CTG
tataactggctcaaatgcct

SEQ ID NO: 306791 - DNA, 20 bp, Artificial Sequence
  Description of Artificial Sequence: Synthetic oligonucleotide
  Target: ATXN1; (+) strand; PAM type: YTN; PAM sequence: CTG
gctcaaatgcctacaaatgg

SEQ ID NO: 306792 - DNA, 20 bp, Artificial Sequence
  Description of Artificial Sequence: Synthetic oligonucleotide
  Target: ATXN1; (+) strand; PAM type: YTN; PAM sequence: CTC
aaatgcctacaaatggaagg

SEQ ID NO: 306793 - DNA, 20 bp, Artificial Sequence
  Description of Artificial Sequence: Synthetic oligonucleotide
  Target: ATXN1; (+) strand; PAM type: YTN; PAM sequence: CTA
caaatggaaggaggtttagt

SEQ ID NO: 306794 - DNA, 20 bp, Artificial Sequence
  Description of Artificial Sequence: Synthetic oligonucleotide
  Target: ATXN1; (+) strand; PAM type: YTN; PAM sequence: TTT
agtagcctaaaatatactct

SEQ ID NO: 306795 - DNA, 20 bp, Artificial Sequence
  Description of Artificial Sequence: Synthetic oligonucleotide
  Target: ATXN1; (+) strand; PAM type: YTN; PAM sequence: TTA
gtagcctaaaatatactcta

SEQ ID NO: 306796 - DNA, 20 bp, Artificial Sequence
  Description of Artificial Sequence: Synthetic oligonucleotide
  Target: ATXN1; (+) strand; PAM type: YTN; PAM sequence: CTA
aaatatactctatttttccc

SEQ ID NO: 306797 - DNA, 20 bp, Artificial Sequence
  Description of Artificial Sequence: Synthetic oligonucleotide
  Target: ATXN1; (+) strand; PAM type: YTN; PAM sequence: CTC
tatttttccctttaagtgca

SEQ ID NO: 306798 - DNA, 20 bp, Artificial Sequence
  Description of Artificial Sequence: Synthetic oligonucleotide
  Target: ATXN1; (+) strand; PAM type: YTN; PAM sequence: CTA
tttttccctttaagtgcaac

SEQ ID NO: 306799 - DNA, 20 bp, Artificial Sequence
  Description of Artificial Sequence: Synthetic oligonucleotide
  Target: ATXN1; (+) strand; PAM type: YTN; PAM sequence: TTT
ttccctttaagtgcaactga

SEQ ID NO: 306800 - DNA, 20 bp, Artificial Sequence
  Description of Artificial Sequence: Synthetic oligonucleotide
  Target: ATXN1; (+) strand; PAM type: YTN; PAM sequence: TTT
tccctttaagtgcaactgaa

SEQ ID NO: 306801 - DNA, 20 bp, Artificial Sequence
  Description of Artificial Sequence: Synthetic oligonucleotide
  Target: ATXN1; (+) strand; PAM type: YTN; PAM sequence: TTT
ccctttaagtgcaactgaat

SEQ ID NO: 306802 - DNA, 20 bp, Artificial Sequence
  Description of Artificial Sequence: Synthetic oligonucleotide
  Target: ATXN1; (+) strand; PAM type: YTN; PAM sequence: TTC
cctttaagtgcaactgaatc

SEQ ID NO: 306803 - DNA, 20 bp, Artificial Sequence
  Description of Artificial Sequence: Synthetic oligonucleotide
  Target: ATXN1; (+) strand; PAM type: YTN; PAM sequence: CTT
taagtgcaactgaatcacaa

SEQ ID NO: 306804 - DNA, 20 bp, Artificial Sequence
  Description of Artificial Sequence: Synthetic oligonucleotide
  Target: ATXN1; (+) strand; PAM type: YTN; PAM sequence: TTT
aagtgcaactgaatcacaat

SEQ ID NO: 306805 - DNA, 20 bp, Artificial Sequence
  Description of Artificial Sequence: Synthetic oligonucleotide
  Target: ATXN1; (+) strand; PAM type: YTN; PAM sequence: TTA
agtgcaactgaatcacaatc

SEQ ID NO: 306806 - DNA, 20 bp, Artificial Sequence
  Description of Artificial Sequence: Synthetic oligonucleotide
  Target: ATXN1; (+) strand; PAM type: YTN; PAM sequence: CTG
aatcacaatccacgagaagc

SEQ ID NO: 306807 - DNA, 20 bp, Artificial Sequence
  Description of Artificial Sequence: Synthetic oligonucleotide
  Target: ATXN1; (+) strand; PAM type: YTN; PAM sequence: TTT
gtgcaaaaaaaaaatgctct

SEQ ID NO: 306808 - DNA, 20 bp, Artificial Sequence
  Description of Artificial Sequence: Synthetic oligonucleotide
  Target: ATXN1; (+) strand; PAM type: YTN; PAM sequence: TTG
tgcaaaaaaaaaatgctctg

SEQ ID NO: 306809 - DNA, 20 bp, Artificial Sequence
  Description of Artificial Sequence: Synthetic oligonucleotide
  Target: ATXN1; (+) strand; PAM type: YTN; PAM sequence: CTC
tgcatgtaagagctacacta

SEQ ID NO: 306810 - DNA, 20 bp, Artificial Sequence
  Description of Artificial Sequence: Synthetic oligonucleotide
  Target: ATXN1; (+) strand; PAM type: YTN; PAM sequence: CTG
catgtaagagctacactaaa

SEQ ID NO: 306811 - DNA, 20 bp, Artificial Sequence
  Description of Artificial Sequence: Synthetic oligonucleotide
  Target: ATXN1; (+) strand; PAM type: YTN; PAM sequence: CTA
cactaaactgcactagaccc

SEQ ID NO: 306812 - DNA, 20 bp, Artificial Sequence
  Description of Artificial Sequence: Synthetic oligonucleotide
  Target: ATXN1; (+) strand; PAM type: YTN; PAM sequence: CTA
aactgcactagaccccgttc

SEQ ID NO: 306813 - DNA, 20 bp, Artificial Sequence
  Description of Artificial Sequence: Synthetic oligonucleotide
  Target: ATXN1; (+) strand; PAM type: YTN; PAM sequence: CTG
cactagaccccgttctaaga

SEQ ID NO: 306814 - DNA, 20 bp, Artificial Sequence
  Description of Artificial Sequence: Synthetic oligonucleotide
  Target: ATXN1; (+) strand; PAM type: YTN; PAM sequence: CTA
gaccccgttctaagataaga

SEQ ID NO: 306815 - DNA, 20 bp, Artificial Sequence
  Description of Artificial Sequence: Synthetic oligonucleotide
  Target: ATXN1; (+) strand; PAM type: YTN; PAM sequence: TTC
taagataagacccgtattaa

SEQ ID NO: 306816 - DNA, 20 bp, Artificial Sequence
  Description of Artificial Sequence: Synthetic oligonucleotide
  Target: ATXN1; (+) strand; PAM type: YTN; PAM sequence: CTA
agataagacccgtattaaca

SEQ ID NO: 306817 - DNA, 20 bp, Artificial Sequence
  Description of Artificial Sequence: Synthetic oligonucleotide
  Target: ATXN1; (+) strand; PAM type: YTN; PAM sequence: TTA
acagagccagggaagaatga

SEQ ID NO: 306818 - DNA, 20 bp, Artificial Sequence
  Description of Artificial Sequence: Synthetic oligonucleotide
  Target: ATXN1; (+) strand; PAM type: YTN; PAM sequence: TTC
tgggagtgcaagatgcattc

SEQ ID NO: 306819 - DNA, 20 bp, Artificial Sequence
  Description of Artificial Sequence: Synthetic oligonucleotide
  Target: ATXN1; (+) strand; PAM type: YTN; PAM sequence: CTG
ggagtgcaagatgcattcag

SEQ ID NO: 306820 - DNA, 20 bp, Artificial Sequence
  Description of Artificial Sequence: Synthetic oligonucleotide
  Target: ATXN1; (+) strand; PAM type: YTN; PAM sequence: TTC
aggggaaaaaaacatcacaa

SEQ ID NO: 306821 - DNA, 20 bp, Artificial Sequence
  Description of Artificial Sequence: Synthetic oligonucleotide
  Target: ATXN1; (+) strand; PAM type: YTN; PAM sequence: CTG
agctgcaatgagaaatgagg

SEQ ID NO: 306822 - DNA, 20 bp, Artificial Sequence
  Description of Artificial Sequence: Synthetic oligonucleotide
  Target: ATXN1; (+) strand; PAM type: YTN; PAM sequence: CTG
caatgagaaatgagggcatc

SEQ ID NO: 306823 - DNA, 20 bp, Artificial Sequence
  Description of Artificial Sequence: Synthetic oligonucleotide
  Target: ATXN1; (+) strand; PAM type: YTN; PAM sequence: TTA
gacagataacgagagaggct

SEQ ID NO: 306824 - DNA, 20 bp, Artificial Sequence
  Description of Artificial Sequence: Synthetic oligonucleotide
  Target: ATXN1; (+) strand; PAM type: YTN; PAM sequence: CTT
tttttttcttttcttttttt

SEQ ID NO: 306825 - DNA, 20 bp, Artificial Sequence
  Description of Artificial Sequence: Synthetic oligonucleotide
  Target: ATXN1; (+) strand; PAM type: YTN; PAM sequence: TTT
ttttttcttttctttttttt

SEQ ID NO: 306826 - DNA, 20 bp, Artificial Sequence
  Description of Artificial Sequence: Synthetic oligonucleotide
  Target: ATXN1; (+) strand; PAM type: YTN; PAM sequence: TTT
tttttcttttcttttttttt

SEQ ID NO: 306827 - DNA, 20 bp, Artificial Sequence
  Description of Artificial Sequence: Synthetic oligonucleotide
  Target: ATXN1; (+) strand; PAM type: YTN; PAM sequence: TTT
ttttcttttctttttttttt

SEQ ID NO: 306828 - DNA, 20 bp, Artificial Sequence
  Description of Artificial Sequence: Synthetic oligonucleotide
  Target: ATXN1; (+) strand; PAM type: YTN; PAM sequence: TTT
tttcttttcttttttttttt

SEQ ID NO: 306829 - DNA, 20 bp, Artificial Sequence
  Description of Artificial Sequence: Synthetic oligonucleotide
  Target: ATXN1; (+) strand; PAM type: YTN; PAM sequence: TTT
ttcttttctttttttttttt

SEQ ID NO: 306830 - DNA, 20 bp, Artificial Sequence
  Description of Artificial Sequence: Synthetic oligonucleotide
  Target: ATXN1; (+) strand; PAM type: YTN; PAM sequence: TTT
tcttttcttttttttttttt

SEQ ID NO: 306831 - DNA, 20 bp, Artificial Sequence
  Description of Artificial Sequence: Synthetic oligonucleotide
  Target: ATXN1; (+) strand; PAM type: YTN; PAM sequence: TTT
cttttctttttttttttttt

SEQ ID NO: 306832 - DNA, 20 bp, Artificial Sequence
  Description of Artificial Sequence: Synthetic oligonucleotide
  Target: ATXN1; (+) strand; PAM type: YTN; PAM sequence: TTC
ttttcttttttttttttttt

SEQ ID NO: 306833 - DNA, 20 bp, Artificial Sequence
  Description of Artificial Sequence: Synthetic oligonucleotide
  Target: ATXN1; (+) strand; PAM type: YTN; PAM sequence: CTT
ttcttttttttttttttttt

SEQ ID NO: 306834 - DNA, 20 bp, Artificial Sequence
  Description of Artificial Sequence: Synthetic oligonucleotide
  Target: ATXN1; (+) strand; PAM type: YTN; PAM sequence: TTT
tctttttttttttttttttt

SEQ ID NO: 306835 - DNA, 20 bp, Artificial Sequence
  Description of Artificial Sequence: Synthetic oligonucleotide
  Target: ATXN1; (+) strand; PAM type: YTN; PAM sequence: TTT
cttttttttttttttttttt

SEQ ID NO: 306836 - DNA, 20 bp, Artificial Sequence
  Description of Artificial Sequence: Synthetic oligonucleotide
  Target: ATXN1; (+) strand; PAM type: YTN; PAM sequence: TTC
tttttttttttttttttttt

SEQ ID NO: 306837 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttttttttt

SEQ ID NO: 306838 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306839 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306840 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306841 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306842 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306843 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306844 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 306845 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttta

SEQ ID NO: 306846 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttaa

SEQ ID NO: 306847 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttaat

SEQ ID NO: 306848 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttaata

SEQ ID NO: 306849 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttaataa

SEQ ID NO: 306850 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttaataaa

SEQ ID NO: 306851 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttaataaaa

SEQ ID NO: 306852 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttaataaaaa

SEQ ID NO: 306853 - DNA, 20 bp, Artificial Sequence
  Description of Artificial Sequence: Synthetic oligonucleotide
  Target: ATXN1; (+) strand; PAM type: YTN; PAM sequence: TTT
tttttttttttaataaaaac

SEQ ID NO: 306854 - DNA, 20 bp, Artificial Sequence
  Description of Artificial Sequence: Synthetic oligonucleotide
  Target: ATXN1; (+) strand; PAM type: YTN; PAM sequence: TTT
ttttttttttaataaaaacg

SEQ ID NO: 306855 - DNA, 20 bp, Artificial Sequence
  Description of Artificial Sequence: Synthetic oligonucleotide
  Target: ATXN1; (+) strand; PAM type: YTN; PAM sequence: TTT
tttttttttaataaaaacgg

SEQ ID NO: 306856 - DNA, 20 bp, Artificial Sequence
  Description of Artificial Sequence: Synthetic oligonucleotide
  Target: ATXN1; (+) strand; PAM type: YTN; PAM sequence: TTT
ttttttttaataaaaacgga

SEQ ID NO: 306857 - DNA, 20 bp, Artificial Sequence
  Description of Artificial Sequence: Synthetic oligonucleotide
  Target: ATXN1; (+) strand; PAM type: YTN; PAM sequence: TTT
tttttttaataaaaacggag

SEQ ID NO: 306858 - DNA, 20 bp, Artificial Sequence
  Description of Artificial Sequence: Synthetic oligonucleotide
  Target: ATXN1; (+) strand; PAM type: YTN; PAM sequence: TTT
ttttttaataaaaacggagg

SEQ ID NO: 306859 - DNA, 20 bp, Artificial Sequence
  Description of Artificial Sequence: Synthetic oligonucleotide
  Target: ATXN1; (+) strand; PAM type: YTN; PAM sequence: TTT
tttttaataaaaacggaggt

SEQ ID NO: 306860 - DNA, 20 bp, Artificial Sequence
  Description of Artificial Sequence: Synthetic oligonucleotide
  Target: ATXN1; (+) strand; PAM type: YTN; PAM sequence: TTT
ttttaataaaaacggaggtc

SEQ ID NO: 306861 - DNA, 20 bp, Artificial Sequence
  Description of Artificial Sequence: Synthetic oligonucleotide
  Target: ATXN1; (+) strand; PAM type: YTN; PAM sequence: TTT
tttaataaaaacggaggtca

SEQ ID NO: 306862 - DNA, 20 bp, Artificial Sequence
  Description of Artificial Sequence: Synthetic oligonucleotide
  Target: ATXN1; (+) strand; PAM type: YTN; PAM sequence: TTT
ttaataaaaacggaggtcat

SEQ ID NO: 306863 - DNA, 20 bp, Artificial Sequence
  Description of Artificial Sequence: Synthetic oligonucleotide
  Target: ATXN1; (+) strand; PAM type: YTN; PAM sequence: TTT
taataaaaacggaggtcatt

SEQ ID NO: 306864 - DNA, 20 bp, Artificial Sequence
  Description of Artificial Sequence: Synthetic oligonucleotide
  Target: ATXN1; (+) strand; PAM type: YTN; PAM sequence: TTT
aataaaaacggaggtcattc

SEQ ID NO: 306865 - DNA, 20 bp, Artificial Sequence
  Description of Artificial Sequence: Synthetic oligonucleotide
  Target: ATXN1; (+) strand; PAM type: YTN; PAM sequence: TTA
ataaaaacggaggtcattcc

SEQ ID NO: 306866 - DNA, 20 bp, Artificial Sequence
  Description of Artificial Sequence: Synthetic oligonucleotide
  Target: ATXN1; (+) strand; PAM type: YTN; PAM sequence: TTC
ctcttgctttcaggagcttg

SEQ ID NO: 306867 - DNA, 20 bp, Artificial Sequence
  Description of Artificial Sequence: Synthetic oligonucleotide
  Target: ATXN1; (+) strand; PAM type: YTN; PAM sequence: CTC
ttgctttcaggagcttgaaa

SEQ ID NO: 306868 - DNA, 20 bp, Artificial Sequence
  Description of Artificial Sequence: Synthetic oligonucleotide
  Target: ATXN1; (+) strand; PAM type: YTN; PAM sequence: CTT
gctttcaggagcttgaaaaa

SEQ ID NO: 306869 - DNA, 20 bp, Artificial Sequence
  Description of Artificial Sequence: Synthetic oligonucleotide
  Target: ATXN1; (+) strand; PAM type: YTN; PAM sequence: TTG
ctttcaggagcttgaaaaat

SEQ ID NO: 306870 - DNA, 20 bp, Artificial Sequence
  Description of Artificial Sequence: Synthetic oligonucleotide
  Target: ATXN1; (+) strand; PAM type: YTN; PAM sequence: CTT
tcaggagcttgaaaaataaa

SEQ ID NO: 306871 - DNA, 20 bp, Artificial Sequence
  Description of Artificial Sequence: Synthetic oligonucleotide
  Target: ATXN1; (+) strand; PAM type: YTN; PAM sequence: TTT
caggagcttgaaaaataaac

SEQ ID NO: 306872 - DNA, 20 bp, Artificial Sequence
  Description of Artificial Sequence: Synthetic oligonucleotide
  Target: ATXN1; (+) strand; PAM type: YTN; PAM sequence: TTC
aggagcttgaaaaataaacc

SEQ ID NO: 306873 - DNA, 20 bp, Artificial Sequence
  Description of Artificial Sequence: Synthetic oligonucleotide
  Target: ATXN1; (+) strand; PAM type: YTN; PAM sequence: CTT
gaaaaataaaccagagcgac

SEQ ID NO: 306874 - DNA, 20 bp, Artificial Sequence
  Description of Artificial Sequence: Synthetic oligonucleotide
  Target: ATXN1; (+) strand; PAM type: YTN; PAM sequence: TTG
aaaaataaaccagagcgacc

SEQ ID NO: 306875 - DNA, 20 bp, Artificial Sequence
  Description of Artificial Sequence: Synthetic oligonucleotide
  Target: ATXN1; (+) strand; PAM type: YTN; PAM sequence: CTG
caaggctttgaccttctggt

SEQ ID NO: 306876 - DNA, 20 bp, Artificial Sequence
  Description of Artificial Sequence: Synthetic oligonucleotide
  Target: ATXN1; (+) strand; PAM type: YTN; PAM sequence: CTT
tgaccttctggtgaagacag

SEQ ID NO: 306877 - DNA, 20 bp, Artificial Sequence
  Description of Artificial Sequence: Synthetic oligonucleotide
  Target: ATXN1; (+) strand; PAM type: YTN; PAM sequence: TTT
gaccttctggtgaagacagc

SEQ ID NO: 306878 - DNA, 20 bp, Artificial Sequence
  Description of Artificial Sequence: Synthetic oligonucleotide
  Target: ATXN1; (+) strand; PAM type: YTN; PAM sequence: TTG
accttctggtgaagacagcc

SEQ ID NO: 306879 - DNA, 20 bp, Artificial Sequence
  Description of Artificial Sequence: Synthetic oligonucleotide
  Target: ATXN1; (+) strand; PAM type: YTN; PAM sequence: CTT
ctggtgaagacagcctttag

SEQ ID NO: 306880 - DNA, 20 bp, Artificial Sequence
  Description of Artificial Sequence: Synthetic oligonucleotide
  Target: ATXN1; (+) strand; PAM type: YTN; PAM sequence: TTC
tggtgaagacagcctttagc

SEQ ID NO: 306881 - DNA, 20 bp, Artificial Sequence
  Description of Artificial Sequence: Synthetic oligonucleotide
  Target: ATXN1; (+) strand; PAM type: YTN; PAM sequence: CTG
gtgaagacagcctttagcag

SEQ ID NO: 306882 - DNA, 20 bp, Artificial Sequence
  Description of Artificial Sequence: Synthetic oligonucleotide
  Target: ATXN1; (+) strand; PAM type: YTN; PAM sequence: CTT
tagcaggaggaacctaatcc

SEQ ID NO: 306883 - DNA, 20 bp, Artificial Sequence
  Description of Artificial Sequence: Synthetic oligonucleotide
  Target: ATXN1; (+) strand; PAM type: YTN; PAM sequence: TTT
agcaggaggaacctaatccc

SEQ ID NO: 306884 - DNA, 20 bp, Artificial Sequence
  Description of Artificial Sequence: Synthetic oligonucleotide
  Target: ATXN1; (+) strand; PAM type: YTN; PAM sequence: TTA
gcaggaggaacctaatccca

SEQ ID NO: 306885 - DNA, 20 bp, Artificial Sequence
  Description of Artificial Sequence: Synthetic oligonucleotide
  Target: ATXN1; (+) strand; PAM type: YTN; PAM sequence: CTA
atcccaggaagttgtctgta

SEQ ID NO: 306886 - DNA, 20 bp, Artificial Sequence
  Description of Artificial Sequence: Synthetic oligonucleotide
  Target: ATXN1; (+) strand; PAM type: YTN; PAM sequence: TTG
tctgtactttgctttctgct

SEQ ID NO: 306887 - DNA, 20 bp, Artificial Sequence
  Description of Artificial Sequence: Synthetic oligonucleotide
  Target: ATXN1; (+) strand; PAM type: YTN; PAM sequence: CTG
tactttgctttctgctacca

SEQ ID NO: 306888 - DNA, 20 bp, Artificial Sequence
  Description of Artificial Sequence: Synthetic oligonucleotide
  Target: ATXN1; (+) strand; PAM type: YTN; PAM sequence: CTT
tgctttctgctaccacacta

SEQ ID NO: 306889 - DNA, 20 bp, Artificial Sequence
  Description of Artificial Sequence: Synthetic oligonucleotide
  Target: ATXN1; (+) strand; PAM type: YTN; PAM sequence: TTT
gctttctgctaccacactag

SEQ ID NO: 306890 - DNA, 20 bp, Artificial Sequence
  Description of Artificial Sequence: Synthetic oligonucleotide
  Target: ATXN1; (+) strand; PAM type: YTN; PAM sequence: TTG
ctttctgctaccacactaga

SEQ ID NO: 306891 - DNA, 20 bp, Artificial Sequence
  Description of Artificial Sequence: Synthetic oligonucleotide
  Target: ATXN1; (+) strand; PAM type: YTN; PAM sequence: CTT
tctgctaccacactagaaga

SEQ ID NO: 306892 - DNA, 20 bp, Artificial Sequence
  Description of Artificial Sequence: Synthetic oligonucleotide
  Target: ATXN1; (+) strand; PAM type: YTN; PAM sequence: TTT
ctgctaccacactagaagat

SEQ ID NO: 306893 - DNA, 20 bp, Artificial Sequence
  Description of Artificial Sequence: Synthetic oligonucleotide
  Target: ATXN1; (+) strand; PAM type: YTN; PAM sequence: TTC
tgctaccacactagaagatt

SEQ ID NO: 306894 - DNA, 20 bp, Artificial Sequence
  Description of Artificial Sequence: Synthetic oligonucleotide
  Target: ATXN1; (+) strand; PAM type: YTN; PAM sequence: CTG
ctaccacactagaagattac

SEQ ID NO: 306895 - DNA, 20 bp, Artificial Sequence
  Description of Artificial Sequence: Synthetic oligonucleotide
  Target: ATXN1; (+) strand; PAM type: YTN; PAM sequence: CTA
ccacactagaagattacttg

SEQ ID NO: 306896 - DNA, 20 bp, Artificial Sequence
  Description of Artificial Sequence: Synthetic oligonucleotide
  Target: ATXN1; (+) strand; PAM type: YTN; PAM sequence: CTA
gaagattacttgatcaaaca

SEQ ID NO: 306897 - DNA, 20 bp, Artificial Sequence
  Description of Artificial Sequence: Synthetic oligonucleotide
  Target: ATXN1; (+) strand; PAM type: YTN; PAM sequence: TTA
cttgatcaaacaaatgggca

SEQ ID NO: 306898 - DNA, 20 bp, Artificial Sequence
  Description of Artificial Sequence: Synthetic oligonucleotide
  Target: ATXN1; (+) strand; PAM type: YTN; PAM sequence: CTT
gatcaaacaaatgggcattt

SEQ ID NO: 306899 - DNA, 20 bp, Artificial Sequence
  Description of Artificial Sequence: Synthetic oligonucleotide
  Target: ATXN1; (+) strand; PAM type: YTN; PAM sequence: TTG
atcaaacaaatgggcatttt

SEQ ID NO: 306900 - DNA, 20 bp, Artificial Sequence
  Description of Artificial Sequence: Synthetic oligonucleotide
  Target: ATXN1; (+) strand; PAM type: YTN; PAM sequence: TTT
ttccccatgatatctctgta

SEQ ID NO: 306901 - DNA, 20 bp, Artificial Sequence
  Description of Artificial Sequence: Synthetic oligonucleotide
  Target: ATXN1; (+) strand; PAM type: YTN; PAM sequence: TTT
tccccatgatatctctgtat

SEQ ID NO: 306902 - DNA, 20 bp, Artificial Sequence
  Description of Artificial Sequence: Synthetic oligonucleotide
  Target: ATXN1; (+) strand; PAM type: YTN; PAM sequence: TTT
ccccatgatatctctgtatc

SEQ ID NO: 306903 - DNA, 20 bp, Artificial Sequence
  Description of Artificial Sequence: Synthetic oligonucleotide
  Target: ATXN1; (+) strand; PAM type: YTN; PAM sequence: TTC
cccatgatatctctgtatca

SEQ ID NO: 306904 - DNA, 20 bp, Artificial Sequence
  Description of Artificial Sequence: Synthetic oligonucleotide
  Target: ATXN1; (+) strand; PAM type: YTN; PAM sequence: CTC
tgtatcatgaaaaagtacat

SEQ ID NO: 306905 - DNA, 20 bp, Artificial Sequence
  Description of Artificial Sequence: Synthetic oligonucleotide
  Target: ATXN1; (+) strand; PAM type: YTN; PAM sequence: CTG
tatcatgaaaaagtacattt

SEQ ID NO: 306906 - DNA, 20 bp, Artificial Sequence
  Description of Artificial Sequence: Synthetic oligonucleotide
  Target: ATXN1; (+) strand; PAM type: YTN; PAM sequence: TTT
gtcatttaatttttatctaa

SEQ ID NO: 306907 - DNA, 20 bp, Artificial Sequence
  Description of Artificial Sequence: Synthetic oligonucleotide
  Target: ATXN1; (+) strand; PAM type: YTN; PAM sequence: TTG
tcatttaatttttatctaat

SEQ ID NO: 306908 - DNA, 20 bp, Artificial Sequence
  Description of Artificial Sequence: Synthetic oligonucleotide
  Target: ATXN1; (+) strand; PAM type: YTN; PAM sequence: TTT
aatttttatctaattgtatt

SEQ ID NO: 306909 - DNA, 20 bp, Artificial Sequence
  Description of Artificial Sequence: Synthetic oligonucleotide
  Target: ATXN1; (+) strand; PAM type: YTN; PAM sequence: TTA
atttttatctaattgtattg

SEQ ID NO: 306910 - DNA, 20 bp, Artificial Sequence
  Description of Artificial Sequence: Synthetic oligonucleotide
  Target: ATXN1; (+) strand; PAM type: YTN; PAM sequence: TTT
ttatctaattgtattgccgt

SEQ ID NO: 306911 - DNA, 20 bp, Artificial Sequence
  Description of Artificial Sequence: Synthetic oligonucleotide
  Target: ATXN1; (+) strand; PAM type: YTN; PAM sequence: TTT
tatctaattgtattgccgtt

SEQ ID NO: 306912 - DNA, 20 bp, Artificial Sequence
  Description of Artificial Sequence: Synthetic oligonucleotide
  Target: ATXN1; (+) strand; PAM type: YTN; PAM sequence: TTT
atctaattgtattgccgttt

SEQ ID NO: 306913 - DNA, 20 bp, Artificial Sequence
  Description of Artificial Sequence: Synthetic oligonucleotide
  Target: ATXN1; (+) strand; PAM type: YTN; PAM sequence: TTA
tctaattgtattgccgtttc

SEQ ID NO: 306914 - DNA, 20 bp, Artificial Sequence
  Description of Artificial Sequence: Synthetic oligonucleotide
  Target: ATXN1; (+) strand; PAM type: YTN; PAM sequence: CTA
attgtattgccgtttccttc

SEQ ID NO: 306915 - DNA, 20 bp, Artificial Sequence
  Description of Artificial Sequence: Synthetic oligonucleotide
  Target: ATXN1; (+) strand; PAM type: YTN; PAM sequence: TTG
tattgccgtttccttctccg

SEQ ID NO: 306916 - DNA, 20 bp, Artificial Sequence
  Description of Artificial Sequence: Synthetic oligonucleotide
  Target: ATXN1; (+) strand; PAM type: YTN; PAM sequence: TTG
ccgtttccttctccgcctct

SEQ ID NO: 306917 - DNA, 20 bp, Artificial Sequence
  Description of Artificial Sequence: Synthetic oligonucleotide
  Target: ATXN1; (+) strand; PAM type: YTN; PAM sequence: TTT
ccttctccgcctctttctcc

SEQ ID NO: 306918 - DNA, 20 bp, Artificial Sequence
  Description of Artificial Sequence: Synthetic oligonucleotide
  Target: ATXN1; (+) strand; PAM type: YTN; PAM sequence: TTC
cttctccgcctctttctccc

SEQ ID NO: 306919 - DNA, 20 bp, Artificial Sequence
  Description of Artificial Sequence: Synthetic oligonucleotide
  Target: ATXN1; (+) strand; PAM type: YTN; PAM sequence: CTT
ctccgcctctttctcccacc

SEQ ID NO: 306920 - DNA, 20 bp, Artificial Sequence
  Description of Artificial Sequence: Synthetic oligonucleotide
  Target: ATXN1; (+) strand; PAM type: YTN; PAM sequence: TTC
tccgcctctttctcccacct

SEQ ID NO: 306921 - DNA, 20 bp, Artificial Sequence
  Description of Artificial Sequence: Synthetic oligonucleotide
  Target: ATXN1; (+) strand; PAM type: YTN; PAM sequence: CTC
cgcctctttctcccacctac

SEQ ID NO: 306922 - DNA, 20 bp, Artificial Sequence
  Description of Artificial Sequence: Synthetic oligonucleotide
  Target: ATXN1; (+) strand; PAM type: YTN; PAM sequence: CTC
tttctcccacctacccccac

SEQ ID NO: 306923 - DNA, 20 bp, Artificial Sequence
  Description of Artificial Sequence: Synthetic oligonucleotide
  Target: ATXN1; (+) strand; PAM type: YTN; PAM sequence: CTT
tctcccacctacccccaccc

SEQ ID NO: 306924 - DNA, 20 bp, Artificial Sequence
  Description of Artificial Sequence: Synthetic oligonucleotide
  Target: ATXN1; (+) strand; PAM type: YTN; PAM sequence: TTT
ctcccacctacccccacccc

SEQ ID NO: 306925 - DNA, 20 bp, Artificial Sequence
  Description of Artificial Sequence: Synthetic oligonucleotide
  Target: ATXN1; (+) strand; PAM type: YTN; PAM sequence: TTC
tcccacctacccccacccct

SEQ ID NO: 306926 - DNA, 20 bp, Artificial Sequence
  Description of Artificial Sequence: Synthetic oligonucleotide
  Target: ATXN1; (+) strand; PAM type: YTN; PAM sequence: CTC
ccacctacccccacccctcc

SEQ ID NO: 306927 - DNA, 20 bp, Artificial Sequence
  Description of Artificial Sequence: Synthetic oligonucleotide
  Target: ATXN1; (+) strand; PAM type: YTN; PAM sequence: CTA
cccccacccctcctacactg

SEQ ID NO: 306928 - DNA, 20 bp, Artificial Sequence
  Description of Artificial Sequence: Synthetic oligonucleotide
  Target: ATXN1; (+) strand; PAM type: YTN; PAM sequence: CTC
ctacactggcattctctgtg

SEQ ID NO: 306929 - DNA, 20 bp, Artificial Sequence
  Description of Artificial Sequence: Synthetic oligonucleotide
  Target: ATXN1; (+) strand; PAM type: YTN; PAM sequence: CTA
cactggcattctctgtggtc

SEQ ID NO: 306930 - DNA, 20 bp, Artificial Sequence
  Description of Artificial Sequence: Synthetic oligonucleotide
  Target: ATXN1; (+) strand; PAM type: YTN; PAM sequence: CTG
gcattctctgtggtcaaaga

SEQ ID NO: 306931 - DNA, 20 bp, Artificial Sequence
  Description of Artificial Sequence: Synthetic oligonucleotide
  Target: ATXN1; (+) strand; PAM type: YTN; PAM sequence: TTC
tctgtggtcaaagaatctgt

SEQ ID NO: 306932 - DNA, 20 bp, Artificial Sequence
  Description of Artificial Sequence: Synthetic oligonucleotide
  Target: ATXN1; (+) strand; PAM type: YTN; PAM sequence: CTC
tgtggtcaaagaatctgttt

SEQ ID NO: 306933 - DNA, 20 bp, Artificial Sequence
  Description of Artificial Sequence: Synthetic oligonucleotide
  Target: ATXN1; (+) strand; PAM type: YTN; PAM sequence: CTG
tggtcaaagaatctgtttca

SEQ ID NO: 306934 - DNA, 20 bp, Artificial Sequence
  Description of Artificial Sequence: Synthetic oligonucleotide
  Target: ATXN1; (+) strand; PAM type: YTN; PAM sequence: CTG
tttcagtattagtgttcaat

SEQ ID NO: 306935 - DNA, 20 bp, Artificial Sequence
  Description of Artificial Sequence: Synthetic oligonucleotide
  Target: ATXN1; (+) strand; PAM type: YTN; PAM sequence: TTT
cagtattagtgttcaatata

SEQ ID NO: 306936 - DNA, 20 bp, Artificial Sequence
  Description of Artificial Sequence: Synthetic oligonucleotide
  Target: ATXN1; (+) strand; PAM type: YTN; PAM sequence: TTC
agtattagtgttcaatatag

SEQ ID NO: 306937 - DNA, 20 bp, Artificial Sequence
  Description of Artificial Sequence: Synthetic oligonucleotide
  Target: ATXN1; (+) strand; PAM type: YTN; PAM sequence: TTA
gtgttcaatatagcaaatgt

SEQ ID NO: 306938 - DNA, 20 bp, Artificial Sequence
  Description of Artificial Sequence: Synthetic oligonucleotide
  Target: ATXN1; (+) strand; PAM type: YTN; PAM sequence: TTC
aatatagcaaatgtcaagta

SEQ ID NO: 306939 - DNA, 20 bp, Artificial Sequence
  Description of Artificial Sequence: Synthetic oligonucleotide
  Target: ATXN1; (+) strand; PAM type: YTN; PAM sequence: CTC
tacacatttcctgtgctatt

SEQ ID NO: 306940 - DNA, 20 bp, Artificial Sequence
  Description of Artificial Sequence: Synthetic oligonucleotide
  Target: ATXN1; (+) strand; PAM type: YTN; PAM sequence: CTA
cacatttcctgtgctattta

SEQ ID NO: 306941 - DNA, 20 bp, Artificial Sequence
  Description of Artificial Sequence: Synthetic oligonucleotide
  Target: ATXN1; (+) strand; PAM type: YTN; PAM sequence: TTT
cctgtgctatttaaagcacc

SEQ ID NO: 306942 - DNA, 20 bp, Artificial Sequence
  Description of Artificial Sequence: Synthetic oligonucleotide
  Target: ATXN1; (+) strand; PAM type: YTN; PAM sequence: TTC
ctgtgctatttaaagcaccc

SEQ ID NO: 306943 - DNA, 20 bp, Artificial Sequence
  Description of Artificial Sequence: Synthetic oligonucleotide
  Target: ATXN1; (+) strand; PAM type: YTN; PAM sequence: CTG
tgctatttaaagcaccctaa

SEQ ID NO: 306944 - DNA, 20 bp, Artificial Sequence
  Description of Artificial Sequence: Synthetic oligonucleotide
  Target: ATXN1; (+) strand; PAM type: YTN; PAM sequence: CTA
tttaaagcaccctaagcaat

SEQ ID NO: 306945 - DNA, 20 bp, Artificial Sequence
  Description of Artificial Sequence: Synthetic oligonucleotide
  Target: ATXN1; (+) strand; PAM type: YTN; PAM sequence: TTT
aaagcaccctaagcaattat

SEQ ID NO: 306946 - DNA, 20 bp, Artificial Sequence
  Description of Artificial Sequence: Synthetic oligonucleotide
  Target: ATXN1; (+) strand; PAM type: YTN; PAM sequence: TTA
aagcaccctaagcaattatt

SEQ ID NO: 306947 - DNA, 20 bp, Artificial Sequence
  Description of Artificial Sequence: Synthetic oligonucleotide
  Target: ATXN1; (+) strand; PAM type: YTN; PAM sequence: CTA
agcaattatttgctctaaag

SEQ ID NO: 306948 - DNA, 20 bp, Artificial Sequence
  Description of Artificial Sequence: Synthetic oligonucleotide
  Target: ATXN1; (+) strand; PAM type: YTN; PAM sequence: TTA
tttgctctaaagtattaaac

SEQ ID NO: 306949 - DNA, 20 bp, Artificial Sequence
  Description of Artificial Sequence: Synthetic oligonucleotide
  Target: ATXN1; (+) strand; PAM type: YTN; PAM sequence: TTT
gctctaaagtattaaactgt

SEQ ID NO: 306950 - DNA, 20 bp, Artificial Sequence
  Description of Artificial Sequence: Synthetic oligonucleotide
  Target: ATXN1; (+) strand; PAM type: YTN; PAM sequence: TTG
ctctaaagtattaaactgta

SEQ ID NO: 306951 - DNA, 20 bp, Artificial Sequence
  Description of Artificial Sequence: Synthetic oligonucleotide
  Target: ATXN1; (+) strand; PAM type: YTN; PAM sequence: CTC
taaagtattaaactgtaaat

SEQ ID NO: 306952 - DNA, 20 bp, Artificial Sequence
  Description of Artificial Sequence: Synthetic oligonucleotide
  Target: ATXN1; (+) strand; PAM type: YTN; PAM sequence: CTA
aagtattaaactgtaaattt

SEQ ID NO: 306953 - DNA, 20 bp, Artificial Sequence
  Description of Artificial Sequence: Synthetic oligonucleotide
  Target: ATXN1; (+) strand; PAM type: YTN; PAM sequence: TTA
aactgtaaattttcttagct

SEQ ID NO: 306954 - DNA, 20 bp, Artificial Sequence
  Description of Artificial Sequence: Synthetic oligonucleotide
  Target: ATXN1; (+) strand; PAM type: YTN; PAM sequence: CTG
taaattttcttagctggtgc

SEQ ID NO: 306955 - DNA, 20 bp, Artificial Sequence
  Description of Artificial Sequence: Synthetic oligonucleotide
  Target: ATXN1; (+) strand; PAM type: YTN; PAM sequence: TTT
tcttagctggtgccaattcc

SEQ ID NO: 306956 - DNA, 20 bp, Artificial Sequence
  Description of Artificial Sequence: Synthetic oligonucleotide
  Target: ATXN1; (+) strand; PAM type: YTN; PAM sequence: TTT
cttagctggtgccaattcct

SEQ ID NO: 306957 - DNA, 20 bp, Artificial Sequence
  Description of Artificial Sequence: Synthetic oligonucleotide
  Target: ATXN1; (+) strand; PAM type: YTN; PAM sequence: TTC
ttagctggtgccaattccta

SEQ ID NO: 306958 - DNA, 20 bp, Artificial Sequence
  Description of Artificial Sequence: Synthetic oligonucleotide
  Target: ATXN1; (+) strand; PAM type: YTN; PAM sequence: CTT
agctggtgccaattcctata

SEQ ID NO: 306959 - DNA, 20 bp, Artificial Sequence
  Description of Artificial Sequence: Synthetic oligonucleotide
  Target: ATXN1; (+) strand; PAM type: YTN; PAM sequence: TTA
gctggtgccaattcctatag

SEQ ID NO: 306960 - DNA, 20 bp, Artificial Sequence
  Description of Artificial Sequence: Synthetic oligonucleotide
  Target: ATXN1; (+) strand; PAM type: YTN; PAM sequence: CTG
gtgccaattcctatagtaat

SEQ ID NO: 306961 - DNA, 20 bp, Artificial Sequence
  Description of Artificial Sequence: Synthetic oligonucleotide
  Target: ATXN1; (+) strand; PAM type: YTN; PAM sequence: TTC
ctatagtaatagctgtcaca

SEQ ID NO: 306962 - DNA, 20 bp, Artificial Sequence
  Description of Artificial Sequence: Synthetic oligonucleotide
  Target: ATXN1; (+) strand; PAM type: YTN; PAM sequence: CTA
tagtaatagctgtcacagaa

SEQ ID NO: 306963 - DNA, 20 bp, Artificial Sequence
  Description of Artificial Sequence: Synthetic oligonucleotide
  Target: ATXN1; (+) strand; PAM type: YTN; PAM sequence: CTG
tcacagaaaagtactttaga

SEQ ID NO: 306964 - DNA, 20 bp, Artificial Sequence
  Description of Artificial Sequence: Synthetic oligonucleotide
  Target: ATXN1; (+) strand; PAM type: YTN; PAM sequence: CTT
tagagtactcaaacacggct

SEQ ID NO: 306965 - DNA, 20 bp, Artificial Sequence
  Description of Artificial Sequence: Synthetic oligonucleotide
  Target: ATXN1; (+) strand; PAM type: YTN; PAM sequence: TTT
agagtactcaaacacggctt

SEQ ID NO: 306966 - DNA, 20 bp, Artificial Sequence
  Description of Artificial Sequence: Synthetic oligonucleotide
  Target: ATXN1; (+) strand; PAM type: YTN; PAM sequence: TTA
gagtactcaaacacggcttt

SEQ ID NO: 306967 - DNA, 20 bp, Artificial Sequence
  Description of Artificial Sequence: Synthetic oligonucleotide
  Target: ATXN1; (+) strand; PAM type: YTN; PAM sequence: CTC
aaacacggcttttaaaccgg

SEQ ID NO: 306968 - DNA, 20 bp, Artificial Sequence
  Description of Artificial Sequence: Synthetic oligonucleotide
  Target: ATXN1; (+) strand; PAM type: YTN; PAM sequence: CTT
ttaaaccggcaacactcatg

SEQ ID NO: 306969 - DNA, 20 bp, Artificial Sequence
  Description of Artificial Sequence: Synthetic oligonucleotide
  Target: ATXN1; (+) strand; PAM type: YTN; PAM sequence: TTT
taaaccggcaacactcatgc

SEQ ID NO: 306970 - DNA, 20 bp, Artificial Sequence
  Description of Artificial Sequence: Synthetic oligonucleotide
  Target: ATXN1; (+) strand; PAM type: YTN; PAM sequence: TTT
aaaccggcaacactcatgct

SEQ ID NO: 306971 - DNA, 20 bp, Artificial Sequence
  Description of Artificial Sequence: Synthetic oligonucleotide
  Target: ATXN1; (+) strand; PAM type: YTN; PAM sequence: TTA
aaccggcaacactcatgcta

SEQ ID NO: 306972 - DNA, 20 bp, Artificial Sequence
  Description of Artificial Sequence: Synthetic oligonucleotide
  Target: ATXN1; (+) strand; PAM type: YTN; PAM sequence: CTC
atgctacatttgccaagact

SEQ ID NO: 306973 - DNA, 20 bp, Artificial Sequence
  Description of Artificial Sequence: Synthetic oligonucleotide
  Target: ATXN1; (+) strand; PAM type: YTN; PAM sequence: CTA
catttgccaagacttttcta

SEQ ID NO: 306974 - DNA, 20 bp, Artificial Sequence
  Description of Artificial Sequence: Synthetic oligonucleotide
  Target: ATXN1; (+) strand; PAM type: YTN; PAM sequence: TTT
gccaagacttttctagttgt

SEQ ID NO: 306975 - DNA, 20 bp, Artificial Sequence
  Description of Artificial Sequence: Synthetic oligonucleotide
  Target: ATXN1; (+) strand; PAM type: YTN; PAM sequence: TTG
ccaagacttttctagttgtc

SEQ ID NO: 306976 - DNA, 20 bp, Artificial Sequence
  Description of Artificial Sequence: Synthetic oligonucleotide
  Target: ATXN1; (+) strand; PAM type: YTN; PAM sequence: CTT
ttctagttgtcatattttta

SEQ ID NO: 306977 - DNA, 20 bp, Artificial Sequence
  Description of Artificial Sequence: Synthetic oligonucleotide
  Target: ATXN1; (+) strand; PAM type: YTN; PAM sequence: TTT
tctagttgtcatatttttat

SEQ ID NO: 306978 - DNA, 20 bp, Artificial Sequence
  Description of Artificial Sequence: Synthetic oligonucleotide
  Target: ATXN1; (+) strand; PAM type: YTN; PAM sequence: TTT
ctagttgtcatatttttata

SEQ ID NO: 306979 - DNA, 20 bp, Artificial Sequence
  Description of Artificial Sequence: Synthetic oligonucleotide
  Target: ATXN1; (+) strand; PAM type: YTN; PAM sequence: TTC
tagttgtcatatttttatag

SEQ ID NO: 306980 - DNA, 20 bp, Artificial Sequence
  Description of Artificial Sequence: Synthetic oligonucleotide
  Target: ATXN1; (+) strand; PAM type: YTN; PAM sequence: CTA
gttgtcatatttttatagca

SEQ ID NO: 306981 - DNA, 20 bp, Artificial Sequence
  Description of Artificial Sequence: Synthetic oligonucleotide
  Target: ATXN1; (+) strand; PAM type: YTN; PAM sequence: TTG
tcatatttttatagcatgtt

SEQ ID NO: 306982 - DNA, 20 bp, Artificial Sequence
  Description of Artificial Sequence: Synthetic oligonucleotide
  Target: ATXN1; (+) strand; PAM type: YTN; PAM sequence: TTT
ttatagcatgtttttgagac

SEQ ID NO: 306983 - DNA, 20 bp, Artificial Sequence
  Description of Artificial Sequence: Synthetic oligonucleotide
  Target: ATXN1; (+) strand; PAM type: YTN; PAM sequence: TTT
tatagcatgtttttgagaca

SEQ ID NO: 306984 - DNA, 20 bp, Artificial Sequence
  Description of Artificial Sequence: Synthetic oligonucleotide
  Target: ATXN1; (+) strand; PAM type: YTN; PAM sequence: TTT
atagcatgtttttgagacaa

SEQ ID NO: 306985 - DNA, 20 bp, Artificial Sequence
  Description of Artificial Sequence: Synthetic oligonucleotide
  Target: ATXN1; (+) strand; PAM type: YTN; PAM sequence: TTA
tagcatgtttttgagacaat

SEQ ID NO: 306986 - DNA, 20 bp, Artificial Sequence
  Description of Artificial Sequence: Synthetic oligonucleotide
  Target: ATXN1; (+) strand; PAM type: YTN; PAM sequence: TTT
ttgagacaatggactaactg

SEQ ID NO: 306987 - DNA, 20 bp, Artificial Sequence
  Description of Artificial Sequence: Synthetic oligonucleotide
  Target: ATXN1; (+) strand; PAM type: YTN; PAM sequence: TTT
tgagacaatggactaactgc

SEQ ID NO: 306988 - DNA, 20 bp, Artificial Sequence
  Description of Artificial Sequence: Synthetic oligonucleotide
  Target: ATXN1; (+) strand; PAM type: YTN; PAM sequence: TTT
gagacaatggactaactgca

SEQ ID NO: 306989 - DNA, 20 bp, Artificial Sequence
  Description of Artificial Sequence: Synthetic oligonucleotide
  Target: ATXN1; (+) strand; PAM type: YTN; PAM sequence: TTG
agacaatggactaactgcaa

SEQ ID NO: 306990 - DNA, 20 bp, Artificial Sequence
  Description of Artificial Sequence: Synthetic oligonucleotide
  Target: ATXN1; (+) strand; PAM type: YTN; PAM sequence: CTA
actgcaacaaagtgtcatat

SEQ ID NO: 306991 - DNA, 20 bp, Artificial Sequence
  Description of Artificial Sequence: Synthetic oligonucleotide
  Target: ATXN1; (+) strand; PAM type: YTN; PAM sequence: CTG
caacaaagtgtcatatgtag

SEQ ID NO: 306992 - DNA, 20 bp, Artificial Sequence
  Description of Artificial Sequence: Synthetic oligonucleotide
  Target: ATXN1; (+) strand; PAM type: YTN; PAM sequence: CTC
ttttttcatatttgaagctt

SEQ ID NO: 306993 - DNA, 20 bp, Artificial Sequence
  Description of Artificial Sequence: Synthetic oligonucleotide
  Target: ATXN1; (+) strand; PAM type: YTN; PAM sequence: CTT
ttttcatatttgaagcttta

SEQ ID NO: 306994 - DNA, 20 bp, Artificial Sequence
  Description of Artificial Sequence: Synthetic oligonucleotide
  Target: ATXN1; (+) strand; PAM type: YTN; PAM sequence: TTT
tttcatatttgaagctttat

SEQ ID NO: 306995 - DNA, 20 bp, Artificial Sequence
  Description of Artificial Sequence: Synthetic oligonucleotide
  Target: ATXN1; (+) strand; PAM type: YTN; PAM sequence: TTT
ttcatatttgaagctttata

SEQ ID NO: 306996 - DNA, 20 bp, Artificial Sequence
  Description of Artificial Sequence: Synthetic oligonucleotide
  Target: ATXN1; (+) strand; PAM type: YTN; PAM sequence: TTT
tcatatttgaagctttatag

SEQ ID NO: 306997 - DNA, 20 bp, Artificial Sequence
  Description of Artificial Sequence: Synthetic oligonucleotide
  Target: ATXN1; (+) strand; PAM type: YTN; PAM sequence: TTT
catatttgaagctttatagg

SEQ ID NO: 306998 - DNA, 20 bp, Artificial Sequence
  Description of Artificial Sequence: Synthetic oligonucleotide
  Target: ATXN1; (+) strand; PAM type: YTN; PAM sequence: TTC
atatttgaagctttataggc

SEQ ID NO: 306999 - DNA, 20 bp, Artificial Sequence
  Description of Artificial Sequence: Synthetic oligonucleotide
  Target: ATXN1; (+) strand; PAM type: YTN; PAM sequence: TTT
gaagctttataggcacactg

SEQ ID NO: 307000 - DNA, 20 bp, Artificial Sequence
  Description of Artificial Sequence: Synthetic oligonucleotide
  Target: ATXN1; (+) strand; PAM type: YTN; PAM sequence: TTG
aagctttataggcacactgt

SEQ ID NO: 307001 - DNA, 20 bp, Artificial Sequence
  Description of Artificial Sequence: Synthetic oligonucleotide
  Target: ATXN1; (+) strand; PAM type: YTN; PAM sequence: CTT
tataggcacactgtagtctt

SEQ ID NO: 307002 - DNA, 20 bp, Artificial Sequence
  Description of Artificial Sequence: Synthetic oligonucleotide
  Target: ATXN1; (+) strand; PAM type: YTN; PAM sequence: TTT
ataggcacactgtagtcttt

SEQ ID NO: 307003 - DNA, 20 bp, Artificial Sequence
  Description of Artificial Sequence: Synthetic oligonucleotide
  Target: ATXN1; (+) strand; PAM type: YTN; PAM sequence: TTA
taggcacactgtagtctttc

SEQ ID NO: 307004 - DNA, 20 bp, Artificial Sequence
  Description of Artificial Sequence: Synthetic oligonucleotide
  Target: ATXN1; (+) strand; PAM type: YTN; PAM sequence: CTG
tagtctttcaacataatttt

SEQ ID NO: 307005 - DNA, 20 bp, Artificial Sequence
  Description of Artificial Sequence: Synthetic oligonucleotide
  Target: ATXN1; (+) strand; PAM type: YTN; PAM sequence: CTT
tcaacataatttttctccaa

SEQ ID NO: 307006 - DNA, 20 bp, Artificial Sequence
  Description of Artificial Sequence: Synthetic oligonucleotide
  Target: ATXN1; (+) strand; PAM type: YTN; PAM sequence: TTT
caacataatttttctccaag

SEQ ID NO: 307007 - DNA, 20 bp, Artificial Sequence
  Description of Artificial Sequence: Synthetic oligonucleotide
  Target: ATXN1; (+) strand; PAM type: YTN; PAM sequence: TTC
aacataatttttctccaagc

SEQ ID NO: 307008 - DNA, 20 bp, Artificial Sequence
  Description of Artificial Sequence: Synthetic oligonucleotide
  Target: ATXN1; (+) strand; PAM type: YTN; PAM sequence: TTT
ttctccaagcaaaaagatga

SEQ ID NO: 307009 - DNA, 20 bp, Artificial Sequence
  Description of Artificial Sequence: Synthetic oligonucleotide
  Target: ATXN1; (+) strand; PAM type: YTN; PAM sequence: TTT
tctccaagcaaaaagatgag

SEQ ID NO: 307010 - DNA, 20 bp, Artificial Sequence
  Description of Artificial Sequence: Synthetic oligonucleotide
  Target: ATXN1; (+) strand; PAM type: YTN; PAM sequence: TTT
ctccaagcaaaaagatgaga

SEQ ID NO: 307011 - DNA, 20 bp, Artificial Sequence
  Description of Artificial Sequence: Synthetic oligonucleotide
  Target: ATXN1; (+) strand; PAM type: YTN; PAM sequence: TTC
tccaagcaaaaagatgagat

SEQ ID NO: 307012 - DNA, 20 bp, Artificial Sequence
  Description of Artificial Sequence: Synthetic oligonucleotide
  Target: ATXN1; (+) strand; PAM type: YTN; PAM sequence: CTC
caagcaaaaagatgagatag

SEQ ID NO: 307013 - DNA, 20 bp, Artificial Sequence
  Description of Artificial Sequence: Synthetic oligonucleotide
  Target: ATXN1; (+) strand; PAM type: YTN; PAM sequence: CTT
caatctcatcgttatactgc

SEQ ID NO: 307014 - DNA, 20 bp, Artificial Sequence
  Description of Artificial Sequence: Synthetic oligonucleotide
  Target: ATXN1; (+) strand; PAM type: YTN; PAM sequence: TTC
aatctcatcgttatactgct

SEQ ID NO: 307015 - DNA, 20 bp, Artificial Sequence
  Description of Artificial Sequence: Synthetic oligonucleotide
  Target: ATXN1; (+) strand; PAM type: YTN; PAM sequence: CTC
atcgttatactgcttggtgt

SEQ ID NO: 307016 - DNA, 20 bp, Artificial Sequence
  Description of Artificial Sequence: Synthetic oligonucleotide
  Target: ATXN1; (+) strand; PAM type: YTN; PAM sequence: TTA
tactgcttggtgttacaggc

SEQ ID NO: 307017 - DNA, 20 bp, Artificial Sequence
  Description of Artificial Sequence: Synthetic oligonucleotide
  Target: ATXN1; (+) strand; PAM type: YTN; PAM sequence: CTG
cttggtgttacaggccagaa

SEQ ID NO: 307018 - DNA, 20 bp, Artificial Sequence
  Description of Artificial Sequence: Synthetic oligonucleotide
  Target: ATXN1; (+) strand; PAM type: YTN; PAM sequence: CTT
ggtgttacaggccagaatca

SEQ ID NO: 307019 - DNA, 20 bp, Artificial Sequence
  Description of Artificial Sequence: Synthetic oligonucleotide
  Target: ATXN1; (+) strand; PAM type: YTN; PAM sequence: TTG
gtgttacaggccagaatcat

SEQ ID NO: 307020 - DNA, 20 bp, Artificial Sequence
  Description of Artificial Sequence: Synthetic oligonucleotide
  Target: ATXN1; (+) strand; PAM type: YTN; PAM sequence: TTA
caggccagaatcatgaccat

SEQ ID NO: 307021 - DNA, 20 bp, Artificial Sequence
  Description of Artificial Sequence: Synthetic oligonucleotide
  Target: ATXN1; (+) strand; PAM type: YTN; PAM sequence: TTG
gaaaatatcactccggccgg

SEQ ID NO: 307022 - DNA, 20 bp, Artificial Sequence
  Description of Artificial Sequence: Synthetic oligonucleotide
  Target: ATXN1; (+) strand; PAM type: YTN; PAM sequence: CTC
cggccgggtgtggtggctca

SEQ ID NO: 307023 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 307024 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttaggag

SEQ ID NO: 307025 - DNA, 20 bp, Artificial Sequence
  Description of Artificial Sequence: Synthetic oligonucleotide
  Target: ATXN1; (+) strand; PAM type: YTN; PAM sequence: CTT
taggaggccgaggcaggtgg

SEQ ID NO: 307026 - DNA, 20 bp, Artificial Sequence
  Description of Artificial Sequence: Synthetic oligonucleotide
  Target: ATXN1; (+) strand; PAM type: YTN; PAM sequence: TTT
aggaggccgaggcaggtgga

SEQ ID NO: 307027 - DNA, 20 bp, Artificial Sequence
  Description of Artificial Sequence: Synthetic oligonucleotide
  Target: ATXN1; (+) strand; PAM type: YTN; PAM sequence: TTA
ggaggccgaggcaggtggat

SEQ ID NO: 307028 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagtttgagacc

SEQ ID NO: 307029 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagtttgagacca

SEQ ID NO: 307030 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctggccaacat

SEQ ID NO: 307031 - DNA, 20 bp, Artificial Sequence
  Description of Artificial Sequence: Synthetic oligonucleotide
  Target: ATXN1; (+) strand; PAM type: YTN; PAM sequence: TTG
agaccagcctggccaacatg

SEQ ID NO: 307032 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaaccccg

SEQ ID NO: 307033 - DNA, 20 bp, Artificial Sequence
  Description of Artificial Sequence: Synthetic oligonucleotide
  Target: ATXN1; (+) strand; PAM type: YTN; PAM sequence: CTC
tactgaaaatacaaaaatta

SEQ ID NO: 307034 - DNA, 20 bp, Artificial Sequence
  Description of Artificial Sequence: Synthetic oligonucleotide
  Target: ATXN1; (+) strand; PAM type: YTN; PAM sequence: CTA
ctgaaaatacaaaaattaac

SEQ ID NO: 307035 - DNA, 20 bp, Artificial Sequence
  Description of Artificial Sequence: Synthetic oligonucleotide
  Target: ATXN1; (+) strand; PAM type: YTN; PAM sequence: CTG
aaaatacaaaaattaaccag

SEQ ID NO: 307036 - DNA, 20 bp, Artificial Sequence
  Description of Artificial Sequence: Synthetic oligonucleotide
  Target: ATXN1; (+) strand; PAM type: YTN; PAM sequence: TTA
accaggcgtgctaatgggtg

SEQ ID NO: 307037 - DNA, 20 bp, Artificial Sequence
  Description of Artificial Sequence: Synthetic oligonucleotide
  Target: ATXN1; (+) strand; PAM type: YTN; PAM sequence: CTA
atgggtgcctgtaattccag

SEQ ID NO: 307038 - DNA, 20 bp, Artificial Sequence
  Description of Artificial Sequence: Synthetic oligonucleotide
  Target: ATXN1; (+) strand; PAM type: YTN; PAM sequence: CTG
taattccagctactttggag

SEQ ID NO: 307039 - DNA, 20 bp, Artificial Sequence
  Description of Artificial Sequence: Synthetic oligonucleotide
  Target: ATXN1; (+) strand; PAM type: YTN; PAM sequence: TTC
cagctactttggaggctgag

SEQ ID NO: 307040 - DNA, 20 bp, Artificial Sequence
  Description of Artificial Sequence: Synthetic oligonucleotide
  Target: ATXN1; (+) strand; PAM type: YTN; PAM sequence: CTA
ctttggaggctgaggcagga

SEQ ID NO: 307041 - DNA, 20 bp, Artificial Sequence
  Description of Artificial Sequence: Synthetic oligonucleotide
  Target: ATXN1; (+) strand; PAM type: YTN; PAM sequence: CTT
tggaggctgaggcaggagaa

SEQ ID NO: 307042 - DNA, 20 bp, Artificial Sequence
  Description of Artificial Sequence: Synthetic oligonucleotide
  Target: ATXN1; (+) strand; PAM type: YTN; PAM sequence: TTT
ggaggctgaggcaggagaat

SEQ ID NO: 307043 - DNA, 20 bp, Artificial Sequence
  Description of Artificial Sequence: Synthetic oligonucleotide
  Target: ATXN1; (+) strand; PAM type: YTN; PAM sequence: TTG
gaggctgaggcaggagaatt

SEQ ID NO: 307044 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttgaa

SEQ ID NO: 307045 - DNA, 20 bp, Artificial Sequence
  Description of Artificial Sequence: Synthetic oligonucleotide
  Target: ATXN1; (+) strand; PAM type: YTN; PAM sequence: TTG
cttgaactcaggaggcagag

SEQ ID NO: 307046 - DNA, 20 bp, Artificial Sequence
  Description of Artificial Sequence: Synthetic oligonucleotide
  Target: ATXN1; (+) strand; PAM type: YTN; PAM sequence: CTT
gaactcaggaggcagaggtt

SEQ ID NO: 307047 - DNA, 20 bp, Artificial Sequence
  Description of Artificial Sequence: Synthetic oligonucleotide
  Target: ATXN1; (+) strand; PAM type: YTN; PAM sequence: TTG
aactcaggaggcagaggttg

SEQ ID NO: 307048 - DNA, 20 bp, Artificial Sequence
  Description of Artificial Sequence: Synthetic oligonucleotide
  Target: ATXN1; (+) strand; PAM type: YTN; PAM sequence: CTC
aggaggcagaggttgcaata

SEQ ID NO: 307049 - DNA, 20 bp, Artificial Sequence
  Description of Artificial Sequence: Synthetic oligonucleotide
  Target: ATXN1; (+) strand; PAM type: YTN; PAM sequence: TTG
caataagccgagatggcacc

SEQ ID NO: 307050 - DNA, 20 bp, Artificial Sequence
  Description of Artificial Sequence: Synthetic oligonucleotide
  Target: ATXN1; (+) strand; PAM type: YTN; PAM sequence: CTC
cactcaagtctgggtaacag

SEQ ID NO: 307051 - DNA, 20 bp, Artificial Sequence
  Description of Artificial Sequence: Synthetic oligonucleotide
  Target: ATXN1; (+) strand; PAM type: YTN; PAM sequence: CTC
aagtctgggtaacagagtga

SEQ ID NO: 307052 - DNA, 20 bp, Artificial Sequence
  Description of Artificial Sequence: Synthetic oligonucleotide
  Target: ATXN1; (+) strand; PAM type: YTN; PAM sequence: CTG
ggtaacagagtgagactcca

SEQ ID NO: 307053 - DNA, 20 bp, Artificial Sequence
  Description of Artificial Sequence: Synthetic oligonucleotide
  Target: ATXN1; (+) strand; PAM type: YTN; PAM sequence: CTC
catctcacacacacacaaaa

SEQ ID NO: 307054 - DNA, 20 bp, Artificial Sequence
  Description of Artificial Sequence: Synthetic oligonucleotide
  Target: ATXN1; (+) strand; PAM type: YTN; PAM sequence: CTC
acacacacacaaaaaaaaat

SEQ ID NO: 307055 - DNA, 20 bp, Artificial Sequence
  Description of Artificial Sequence: Synthetic oligonucleotide
  Target: ATXN1; (+) strand; PAM type: YTN; PAM sequence: CTC
catttgataaagctccaaat

SEQ ID NO: 307056 - DNA, 20 bp, Artificial Sequence
  Description of Artificial Sequence: Synthetic oligonucleotide
  Target: ATXN1; (+) strand; PAM type: YTN; PAM sequence: TTT
gataaagctccaaatcataa

SEQ ID NO: 307057 - DNA, 20 bp, Artificial Sequence
  Description of Artificial Sequence: Synthetic oligonucleotide
  Target: ATXN1; (+) strand; PAM type: YTN; PAM sequence: TTG
ataaagctccaaatcataat

SEQ ID NO: 307058 - DNA, 20 bp, Artificial Sequence
  Description of Artificial Sequence: Synthetic oligonucleotide
  Target: ATXN1; (+) strand; PAM type: YTN; PAM sequence: CTC
caaatcataatagctgataa

SEQ ID NO: 307059 - DNA, 20 bp, Artificial Sequence
  Description of Artificial Sequence: Synthetic oligonucleotide
  Target: ATXN1; (+) strand; PAM type: YTN; PAM sequence: CTG
ataaaagagtcccccaacac

SEQ ID NO: 307060 - DNA, 20 bp, Artificial Sequence
  Description of Artificial Sequence: Synthetic oligonucleotide
  Target: ATXN1; (+) strand; PAM type: YTN; PAM sequence: CTA
gttctataaagggtgcacac

SEQ ID NO: 307061 - DNA, 20 bp, Artificial Sequence
  Description of Artificial Sequence: Synthetic oligonucleotide
  Target: ATXN1; (+) strand; PAM type: YTN; PAM sequence: TTC
tataaagggtgcacactgta

SEQ ID NO: 307062 - DNA, 20 bp, Artificial Sequence
  Description of Artificial Sequence: Synthetic oligonucleotide
  Target: ATXN1; (+) strand; PAM type: YTN; PAM sequence: CTA
taaagggtgcacactgtatt

SEQ ID NO: 307063 - DNA, 20 bp, Artificial Sequence
  Description of Artificial Sequence: Synthetic oligonucleotide
  Target: ATXN1; (+) strand; PAM type: YTN; PAM sequence: CTG
tatttacacatacaaatgca

SEQ ID NO: 307064 - DNA, 20 bp, Artificial Sequence
  Description of Artificial Sequence: Synthetic oligonucleotide
  Target: ATXN1; (+) strand; PAM type: YTN; PAM sequence: TTT
acacatacaaatgcatgcag

SEQ ID NO: 307065 - DNA, 20 bp, Artificial Sequence
  Description of Artificial Sequence: Synthetic oligonucleotide
  Target: ATXN1; (+) strand; PAM type: YTN; PAM sequence: TTA
cacatacaaatgcatgcagc

SEQ ID NO: 307066 - DNA, 20 bp, Artificial Sequence
  Description of Artificial Sequence: Synthetic oligonucleotide
  Target: ATXN1; (+) strand; PAM type: YTN; PAM sequence: CTT
gaaaaatattaagcaaccaa

SEQ ID NO: 307067 - DNA, 20 bp, Artificial Sequence
  Description of Artificial Sequence: Synthetic oligonucleotide
  Target: ATXN1; (+) strand; PAM type: YTN; PAM sequence: TTG
aaaaatattaagcaaccaaa

SEQ ID NO: 307068 - DNA, 20 bp, Artificial Sequence
  Description of Artificial Sequence: Synthetic oligonucleotide
  Target: ATXN1; (+) strand; PAM type: YTN; PAM sequence: TTA
agcaaccaaaacatacatat

SEQ ID NO: 307069 - DNA, 20 bp, Artificial Sequence
  Description of Artificial Sequence: Synthetic oligonucleotide
  Target: ATXN1; (+) strand; PAM type: YTN; PAM sequence: CTA
atatacttctacatgtatgc

SEQ ID NO: 307070 - DNA, 20 bp, Artificial Sequence
  Description of Artificial Sequence: Synthetic oligonucleotide
  Target: ATXN1; (+) strand; PAM type: YTN; PAM sequence: CTT
ctacatgtatgcccttatta

SEQ ID NO: 307071 - DNA, 20 bp, Artificial Sequence
  Description of Artificial Sequence: Synthetic oligonucleotide
  Target: ATXN1; (+) strand; PAM type: YTN; PAM sequence: TTC
tacatgtatgcccttattaa

SEQ ID NO: 307072 - DNA, 20 bp, Artificial Sequence
  Description of Artificial Sequence: Synthetic oligonucleotide
  Target: ATXN1; (+) strand; PAM type: YTN; PAM sequence: CTA
catgtatgcccttattaagt

SEQ ID NO: 307073 - DNA, 20 bp, Artificial Sequence
  Description of Artificial Sequence: Synthetic oligonucleotide
  Target: ATXN1; (+) strand; PAM type: YTN; PAM sequence: CTT
attaagtacttttatgtttg

SEQ ID NO: 307074 - DNA, 20 bp, Artificial Sequence
  Description of Artificial Sequence: Synthetic oligonucleotide
  Target: ATXN1; (+) strand; PAM type: YTN; PAM sequence: TTA
ttaagtacttttatgtttga

SEQ ID NO: 307075 - DNA, 20 bp, Artificial Sequence
  Description of Artificial Sequence: Synthetic oligonucleotide
  Target: ATXN1; (+) strand; PAM type: YTN; PAM sequence: TTA
agtacttttatgtttgacta

SEQ ID NO: 307076 - DNA, 20 bp, Artificial Sequence
  Description of Artificial Sequence: Synthetic oligonucleotide
  Target: ATXN1; (+) strand; PAM type: YTN; PAM sequence: CTT
ttatgtttgactagatgtgc

SEQ ID NO: 307077 - DNA, 20 bp, Artificial Sequence
  Description of Artificial Sequence: Synthetic oligonucleotide
  Target: ATXN1; (+) strand; PAM type: YTN; PAM sequence: TTT
tatgtttgactagatgtgct

SEQ ID NO: 307078 - DNA, 20 bp, Artificial Sequence
  Description of Artificial Sequence: Synthetic oligonucleotide
  Target: ATXN1; (+) strand; PAM type: YTN; PAM sequence: TTT
atgtttgactagatgtgctt

SEQ ID NO: 307079 - DNA, 20 bp, Artificial Sequence
  Description of Artificial Sequence: Synthetic oligonucleotide
  Target: ATXN1; (+) strand; PAM type: YTN; PAM sequence: TTA
tgtttgactagatgtgcttc

SEQ ID NO: 307080 - DNA, 20 bp, Artificial Sequence
  Description of Artificial Sequence: Synthetic oligonucleotide
  Target: ATXN1; (+) strand; PAM type: YTN; PAM sequence: TTT
gactagatgtgcttcttttg

SEQ ID NO: 307081 - DNA, 20 bp, Artificial Sequence
  Description of Artificial Sequence: Synthetic oligonucleotide
  Target: ATXN1; (+) strand; PAM type: YTN; PAM sequence: TTG
actagatgtgcttcttttga

SEQ ID NO: 307082 - DNA, 20 bp, Artificial Sequence
  Description of Artificial Sequence: Synthetic oligonucleotide
  Target: ATXN1; (+) strand; PAM type: YTN; PAM sequence: CTA
gatgtgcttcttttgaaatc

SEQ ID NO: 307083 - DNA, 20 bp, Artificial Sequence
  Description of Artificial Sequence: Synthetic oligonucleotide
  Target: ATXN1; (+) strand; PAM type: YTN; PAM sequence: CTT
cttttgaaatctttttagct

SEQ ID NO: 307084 - DNA, 20 bp, Artificial Sequence
  Description of Artificial Sequence: Synthetic oligonucleotide
  Target: ATXN1; (+) strand; PAM type: YTN; PAM sequence: TTC
ttttgaaatctttttagctt

SEQ ID NO: 307085 - DNA, 20 bp, Artificial Sequence
  Description of Artificial Sequence: Synthetic oligonucleotide
  Target: ATXN1; (+) strand; PAM type: YTN; PAM sequence: CTT
ttgaaatctttttagcttca

SEQ ID NO: 307086 - DNA, 20 bp, Artificial Sequence
  Description of Artificial Sequence: Synthetic oligonucleotide
  Target: ATXN1; (+) strand; PAM type: YTN; PAM sequence: TTT
tgaaatctttttagcttcat

SEQ ID NO: 307087 - DNA, 20 bp, Artificial Sequence
  Description of Artificial Sequence: Synthetic oligonucleotide
  Target: ATXN1; (+) strand; PAM type: YTN; PAM sequence: TTT
gaaatctttttagcttcatt

SEQ ID NO: 307088 - DNA, 20 bp, Artificial Sequence
  Description of Artificial Sequence: Synthetic oligonucleotide
  Target: ATXN1; (+) strand; PAM type: YTN; PAM sequence: TTG
aaatctttttagcttcatta

SEQ ID NO: 307089 - DNA, 20 bp, Artificial Sequence
  Description of Artificial Sequence: Synthetic oligonucleotide
  Target: ATXN1; (+) strand; PAM type: YTN; PAM sequence: CTT
tttagcttcattacatgttt

SEQ ID NO: 307090 - DNA, 20 bp, Artificial Sequence
  Description of Artificial Sequence: Synthetic oligonucleotide
  Target: ATXN1; (+) strand; PAM type: YTN; PAM sequence: TTT
ttagcttcattacatgtttt

SEQ ID NO: 307091 - DNA, 20 bp, Artificial Sequence
  Description of Artificial Sequence: Synthetic oligonucleotide
  Target: ATXN1; (+) strand; PAM type: YTN; PAM sequence: TTT
tagcttcattacatgttttt

SEQ ID NO: 307092 - DNA, 20 bp, Artificial Sequence
  Description of Artificial Sequence: Synthetic oligonucleotide
  Target: ATXN1; (+) strand; PAM type: YTN; PAM sequence: TTT
agcttcattacatgtttttg

SEQ ID NO: 307093 - DNA, 20 bp, Artificial Sequence
  Description of Artificial Sequence: Synthetic oligonucleotide
  Target: ATXN1; (+) strand; PAM type: YTN; PAM sequence: TTA
gcttcattacatgtttttgt

SEQ ID NO: 307094 - DNA, 20 bp, Artificial Sequence
  Description of Artificial Sequence: Synthetic oligonucleotide
  Target: ATXN1; (+) strand; PAM type: YTN; PAM sequence: CTT
cattacatgtttttgtaatt

SEQ ID NO: 307095 - DNA, 20 bp, Artificial Sequence
  Description of Artificial Sequence: Synthetic oligonucleotide
  Target: ATXN1; (+) strand; PAM type: YTN; PAM sequence: TTC
attacatgtttttgtaattt

SEQ ID NO: 307096 - DNA, 20 bp, Artificial Sequence
  Description of Artificial Sequence: Synthetic oligonucleotide
  Target: ATXN1; (+) strand; PAM type: YTN; PAM sequence: TTA
catgtttttgtaatttcatg

SEQ ID NO: 307097 - DNA, 20 bp, Artificial Sequence
  Description of Artificial Sequence: Synthetic oligonucleotide
  Target: ATXN1; (+) strand; PAM type: YTN; PAM sequence: TTT
ttgtaatttcatggaagtaa

SEQ ID NO: 307098 - DNA, 20 bp, Artificial Sequence
  Description of Artificial Sequence: Synthetic oligonucleotide
  Target: ATXN1; (+) strand; PAM type: YTN; PAM sequence: TTT
tgtaatttcatggaagtaaa

SEQ ID NO: 307099 - DNA, 20 bp, Artificial Sequence
  Description of Artificial Sequence: Synthetic oligonucleotide
  Target: ATXN1; (+) strand; PAM type: YTN; PAM sequence: TTT
gtaatttcatggaagtaaat

SEQ ID NO: 307100 - DNA, 20 bp, Artificial Sequence
  Description of Artificial Sequence: Synthetic oligonucleotide
  Target: ATXN1; (+) strand; PAM type: YTN; PAM sequence: TTG
taatttcatggaagtaaatt

SEQ ID NO: 307101 - DNA, 20 bp, Artificial Sequence
  Description of Artificial Sequence: Synthetic oligonucleotide
  Target: ATXN1; (+) strand; PAM type: YTN; PAM sequence: TTT
catggaagtaaattaaaagt

SEQ ID NO: 307102 - DNA, 20 bp, Artificial Sequence
  Description of Artificial Sequence: Synthetic oligonucleotide
  Target: ATXN1; (+) strand; PAM type: YTN; PAM sequence: TTC
atggaagtaaattaaaagta

SEQ ID NO: 307103 - DNA, 20 bp, Artificial Sequence
  Description of Artificial Sequence: Synthetic oligonucleotide
  Target: ATXN1; (+) strand; PAM type: YTN; PAM sequence: TTA
aaagtaacatagttctaaat

SEQ ID NO: 307104 - DNA, 20 bp, Artificial Sequence
  Description of Artificial Sequence: Synthetic oligonucleotide
  Target: ATXN1; (+) strand; PAM type: YTN; PAM sequence: TTC
taaatcctaaacagctaaga

SEQ ID NO: 307105 - DNA, 20 bp, Artificial Sequence
  Description of Artificial Sequence: Synthetic oligonucleotide
  Target: ATXN1; (+) strand; PAM type: YTN; PAM sequence: CTA
aatcctaaacagctaagact

SEQ ID NO: 307106 - DNA, 20 bp, Artificial Sequence
  Description of Artificial Sequence: Synthetic oligonucleotide
  Target: ATXN1; (+) strand; PAM type: YTN; PAM sequence: CTA
aacagctaagactgcattaa

SEQ ID NO: 307107 - DNA, 20 bp, Artificial Sequence
  Description of Artificial Sequence: Synthetic oligonucleotide
  Target: ATXN1; (+) strand; PAM type: YTN; PAM sequence: CTA
agactgcattaaattgccac

SEQ ID NO: 307108 - DNA, 20 bp, Artificial Sequence
  Description of Artificial Sequence: Synthetic oligonucleotide
  Target: ATXN1; (+) strand; PAM type: YTN; PAM sequence: CTG
cattaaattgccacctccat

SEQ ID NO: 307109 - DNA, 20 bp, Artificial Sequence
  Description of Artificial Sequence: Synthetic oligonucleotide
  Target: ATXN1; (+) strand; PAM type: YTN; PAM sequence: TTA
aattgccacctccatctaca

SEQ ID NO: 307110 - DNA, 20 bp, Artificial Sequence
  Description of Artificial Sequence: Synthetic oligonucleotide
  Target: ATXN1; (+) strand; PAM type: YTN; PAM sequence: TTG
ccacctccatctacagaatt

SEQ ID NO: 307111 - DNA, 20 bp, Artificial Sequence
  Description of Artificial Sequence: Synthetic oligonucleotide
  Target: ATXN1; (+) strand; PAM type: YTN; PAM sequence: CTC
catctacagaattgtatggc

SEQ ID NO: 307112 - DNA, 20 bp, Artificial Sequence
  Description of Artificial Sequence: Synthetic oligonucleotide
  Target: ATXN1; (+) strand; PAM type: YTN; PAM sequence: CTA
cagaattgtatggcccttga

SEQ ID NO: 307113 - DNA, 20 bp, Artificial Sequence
  Description of Artificial Sequence: Synthetic oligonucleotide
  Target: ATXN1; (+) strand; PAM type: YTN; PAM sequence: TTG
tatggcccttgaaaaacttc

SEQ ID NO: 307114 - DNA, 20 bp, Artificial Sequence
  Description of Artificial Sequence: Synthetic oligonucleotide
  Target: ATXN1; (+) strand; PAM type: YTN; PAM sequence: CTT
gaaaaacttccatggatgag

SEQ ID NO: 307115 - DNA, 20 bp, Artificial Sequence
  Description of Artificial Sequence: Synthetic oligonucleotide
  Target: ATXN1; (+) strand; PAM type: YTN; PAM sequence: TTG
aaaaacttccatggatgagt

SEQ ID NO: 307116 - DNA, 20 bp, Artificial Sequence
  Description of Artificial Sequence: Synthetic oligonucleotide
  Target: ATXN1; (+) strand; PAM type: YTN; PAM sequence: CTT
ccatggatgagtgcaatttg

SEQ ID NO: 307117 - DNA, 20 bp, Artificial Sequence
  Description of Artificial Sequence: Synthetic oligonucleotide
  Target: ATXN1; (+) strand; PAM type: YTN; PAM sequence: TTC
catggatgagtgcaatttgc

SEQ ID NO: 307118 - DNA, 20 bp, Artificial Sequence
  Description of Artificial Sequence: Synthetic oligonucleotide
  Target: ATXN1; (+) strand; PAM type: YTN; PAM sequence: TTT
gcaaccaaaaccaaaagcct

SEQ ID NO: 307119 - DNA, 20 bp, Artificial Sequence
  Description of Artificial Sequence: Synthetic oligonucleotide
  Target: ATXN1; (+) strand; PAM type: YTN; PAM sequence: TTG
caaccaaaaccaaaagcctc

SEQ ID NO: 307120 - DNA, 20 bp, Artificial Sequence
  Description of Artificial Sequence: Synthetic oligonucleotide
  Target: ATXN1; (+) strand; PAM type: YTN; PAM sequence: CTC
tttacctattttttaaatgt

SEQ ID NO: 307121 - DNA, 20 bp, Artificial Sequence
  Description of Artificial Sequence: Synthetic oligonucleotide
  Target: ATXN1; (+) strand; PAM type: YTN; PAM sequence: CTT
tacctattttttaaatgtag

SEQ ID NO: 307122 - DNA, 20 bp, Artificial Sequence
  Description of Artificial Sequence: Synthetic oligonucleotide
  Target: ATXN1; (+) strand; PAM type: YTN; PAM sequence: TTT
acctattttttaaatgtagt

SEQ ID NO: 307123 - DNA, 20 bp, Artificial Sequence
  Description of Artificial Sequence: Synthetic oligonucleotide
  Target: ATXN1; (+) strand; PAM type: YTN; PAM sequence: TTA
cctattttttaaatgtagtg

SEQ ID NO: 307124 - DNA, 20 bp, Artificial Sequence
  Description of Artificial Sequence: Synthetic oligonucleotide
  Target: ATXN1; (+) strand; PAM type: YTN; PAM sequence: CTA
ttttttaaatgtagtgaatt

SEQ ID NO: 307125 - DNA, 20 bp, Artificial Sequence
  Description of Artificial Sequence: Synthetic oligonucleotide
  Target: ATXN1; (+) strand; PAM type: YTN; PAM sequence: TTT
tttaaatgtagtgaattatt

SEQ ID NO: 307126 - DNA, 20 bp, Artificial Sequence
  Description of Artificial Sequence: Synthetic oligonucleotide
  Target: ATXN1; (+) strand; PAM type: YTN; PAM sequence: TTT
ttaaatgtagtgaattattc

SEQ ID NO: 307127 - DNA, 20 bp, Artificial Sequence
  Description of Artificial Sequence: Synthetic oligonucleotide
  Target: ATXN1; (+) strand; PAM type: YTN; PAM sequence: TTT
taaatgtagtgaattattca

SEQ ID NO: 307128 - DNA, 20 bp, Artificial Sequence
  Description of Artificial Sequence: Synthetic oligonucleotide
  Target: ATXN1; (+) strand; PAM type: YTN; PAM sequence: TTT
aaatgtagtgaattattcaa

SEQ ID NO: 307129 - DNA, 20 bp, Artificial Sequence
  Description of Artificial Sequence: Synthetic oligonucleotide
  Target: ATXN1; (+) strand; PAM type: YTN; PAM sequence: TTA
aatgtagtgaattattcaaa

SEQ ID NO: 307130 - DNA, 20 bp, Artificial Sequence
  Description of Artificial Sequence: Synthetic oligonucleotide
  Target: ATXN1; (+) strand; PAM type: YTN; PAM sequence: TTA
ttcaaacatattttccaacc

SEQ ID NO: 307131 - DNA, 20 bp, Artificial Sequence
  Description of Artificial Sequence: Synthetic oligonucleotide
  Target: ATXN1; (+) strand; PAM type: YTN; PAM sequence: TTC
aaacatattttccaaccgat

SEQ ID NO: 307132 - DNA, 20 bp, Artificial Sequence
  Description of Artificial Sequence: Synthetic oligonucleotide
  Target: ATXN1; (+) strand; PAM type: YTN; PAM sequence: TTT
tccaaccgatgaaagaattc

SEQ ID NO: 307133 - DNA, 20 bp, Artificial Sequence
  Description of Artificial Sequence: Synthetic oligonucleotide
  Target: ATXN1; (+) strand; PAM type: YTN; PAM sequence: TTT
ccaaccgatgaaagaattct

SEQ ID NO: 307134 - DNA, 20 bp, Artificial Sequence
  Description of Artificial Sequence: Synthetic oligonucleotide
  Target: ATXN1; (+) strand; PAM type: YTN; PAM sequence: TTC
caaccgatgaaagaattctc

SEQ ID NO: 307135 - DNA, 20 bp, Artificial Sequence
  Description of Artificial Sequence: Synthetic oligonucleotide
  Target: ATXN1; (+) strand; PAM type: YTN; PAM sequence: TTC
tcttattcctgccatgccgg

SEQ ID NO: 307136 - DNA, 20 bp, Artificial Sequence
  Description of Artificial Sequence: Synthetic oligonucleotide
  Target: ATXN1; (+) strand; PAM type: YTN; PAM sequence: CTC
ttattcctgccatgccggga

SEQ ID NO: 307137 - DNA, 20 bp, Artificial Sequence
  Description of Artificial Sequence: Synthetic oligonucleotide
  Target: ATXN1; (+) strand; PAM type: YTN; PAM sequence: CTT
attcctgccatgccgggacc

SEQ ID NO: 307138 - DNA, 20 bp, Artificial Sequence
  Description of Artificial Sequence: Synthetic oligonucleotide
  Target: ATXN1; (+) strand; PAM type: YTN; PAM sequence: TTA
ttcctgccatgccgggaccc

SEQ ID NO: 307139 - DNA, 20 bp, Artificial Sequence
  Description of Artificial Sequence: Synthetic oligonucleotide
  Target: ATXN1; (+) strand; PAM type: YTN; PAM sequence: TTC
ctgccatgccgggacccatt

SEQ ID NO: 307140 - DNA, 20 bp, Artificial Sequence
  Description of Artificial Sequence: Synthetic oligonucleotide
  Target: ATXN1; (+) strand; PAM type: YTN; PAM sequence: CTG
ccatgccgggacccattctg

SEQ ID NO: 307141 - DNA, 20 bp, Artificial Sequence
  Description of Artificial Sequence: Synthetic oligonucleotide
  Target: ATXN1; (+) strand; PAM type: YTN; PAM sequence: TTC
tgagttttacacccaccata

SEQ ID NO: 307142 - DNA, 20 bp, Artificial Sequence
  Description of Artificial Sequence: Synthetic oligonucleotide
  Target: ATXN1; (+) strand; PAM type: YTN; PAM sequence: CTG
agttttacacccaccatacc

SEQ ID NO: 307143 - DNA, 20 bp, Artificial Sequence
  Description of Artificial Sequence: Synthetic oligonucleotide
  Target: ATXN1; (+) strand; PAM type: YTN; PAM sequence: TTT
tacacccaccataccaggta

SEQ ID NO: 307144 - DNA, 20 bp, Artificial Sequence
  Description of Artificial Sequence: Synthetic oligonucleotide
  Target: ATXN1; (+) strand; PAM type: YTN; PAM sequence: TTT
acacccaccataccaggtat

SEQ ID NO: 307145 - DNA, 20 bp, Artificial Sequence
  Description of Artificial Sequence: Synthetic oligonucleotide
  Target: ATXN1; (+) strand; PAM type: YTN; PAM sequence: TTA
cacccaccataccaggtatt

SEQ ID NO: 307146 - DNA, 20 bp, Artificial Sequence
  Description of Artificial Sequence: Synthetic oligonucleotide
  Target: ATXN1; (+) strand; PAM type: YTN; PAM sequence: TTA
ctacttgctgaaagcctgca

SEQ ID NO: 307147 - DNA, 20 bp, Artificial Sequence
  Description of Artificial Sequence: Synthetic oligonucleotide
  Target: ATXN1; (+) strand; PAM type: YTN; PAM sequence: CTA
cttgctgaaagcctgcatta

SEQ ID NO: 307148 - DNA, 20 bp, Artificial Sequence
  Description of Artificial Sequence: Synthetic oligonucleotide
  Target: ATXN1; (+) strand; PAM type: YTN; PAM sequence: CTT
gctgaaagcctgcattaaag

SEQ ID NO: 307149 - DNA, 20 bp, Artificial Sequence
  Description of Artificial Sequence: Synthetic oligonucleotide
  Target: ATXN1; (+) strand; PAM type: YTN; PAM sequence: TTG
ctgaaagcctgcattaaagc

SEQ ID NO: 307150 - DNA, 20 bp, Artificial Sequence
  Description of Artificial Sequence: Synthetic oligonucleotide
  Target: ATXN1; (+) strand; PAM type: YTN; PAM sequence: CTG
aaagcctgcattaaagcatt

SEQ ID NO: 307151 - DNA, 20 bp, Artificial Sequence
  Description of Artificial Sequence: Synthetic oligonucleotide
  Target: ATXN1; (+) strand; PAM type: YTN; PAM sequence: CTG
cattaaagcattaagggaca

SEQ ID NO: 307152 - DNA, 20 bp, Artificial Sequence
  Description of Artificial Sequence: Synthetic oligonucleotide
  Target: ATXN1; (+) strand; PAM type: YTN; PAM sequence: TTA
aagcattaagggacaacaac

SEQ ID NO: 307153 - DNA, 20 bp, Artificial Sequence
  Description of Artificial Sequence: Synthetic oligonucleotide
  Target: ATXN1; (+) strand; PAM type: YTN; PAM sequence: TTA
agggacaacaacaaggttac

SEQ ID NO: 307154 - DNA, 20 bp, Artificial Sequence
  Description of Artificial Sequence: Synthetic oligonucleotide
  Target: ATXN1; (+) strand; PAM type: YTN; PAM sequence: TTA
cattatcttaacatattcca

SEQ ID NO: 307155 - DNA, 20 bp, Artificial Sequence
  Description of Artificial Sequence: Synthetic oligonucleotide
  Target: ATXN1; (+) strand; PAM type: YTN; PAM sequence: TTA
tcttaacatattccacttaa

SEQ ID NO: 307156 - DNA, 20 bp, Artificial Sequence
  Description of Artificial Sequence: Synthetic oligonucleotide
  Target: ATXN1; (+) strand; PAM type: YTN; PAM sequence: CTT
aacatattccacttaatggt

SEQ ID NO: 307157 - DNA, 20 bp, Artificial Sequence
  Description of Artificial Sequence: Synthetic oligonucleotide
  Target: ATXN1; (+) strand; PAM type: YTN; PAM sequence: TTA
acatattccacttaatggtt

SEQ ID NO: 307158 - DNA, 20 bp, Artificial Sequence
  Description of Artificial Sequence: Synthetic oligonucleotide
  Target: ATXN1; (+) strand; PAM type: YTN; PAM sequence: TTC
cacttaatggtttttgattg

SEQ ID NO: 307159 - DNA, 20 bp, Artificial Sequence
  Description of Artificial Sequence: Synthetic oligonucleotide
  Target: ATXN1; (+) strand; PAM type: YTN; PAM sequence: CTT
aatggtttttgattgtgtta

SEQ ID NO: 307160 - DNA, 20 bp, Artificial Sequence
  Description of Artificial Sequence: Synthetic oligonucleotide
  Target: ATXN1; (+) strand; PAM type: YTN; PAM sequence: TTA
atggtttttgattgtgttat

SEQ ID NO: 307161 - DNA, 20 bp, Artificial Sequence
  Description of Artificial Sequence: Synthetic oligonucleotide
  Target: ATXN1; (+) strand; PAM type: YTN; PAM sequence: TTT
ttgattgtgttatgaagtgc

SEQ ID NO: 307162 - DNA, 20 bp, Artificial Sequence
  Description of Artificial Sequence: Synthetic oligonucleotide
  Target: ATXN1; (+) strand; PAM type: YTN; PAM sequence: TTT
tgattgtgttatgaagtgcc

SEQ ID NO: 307163 - DNA, 20 bp, Artificial Sequence
  Description of Artificial Sequence: Synthetic oligonucleotide
  Target: ATXN1; (+) strand; PAM type: YTN; PAM sequence: TTT
gattgtgttatgaagtgccc

SEQ ID NO: 307164 - DNA, 20 bp, Artificial Sequence
  Description of Artificial Sequence: Synthetic oligonucleotide
  Target: ATXN1; (+) strand; PAM type: YTN; PAM sequence: TTG
attgtgttatgaagtgccct

SEQ ID NO: 307165 - DNA, 20 bp, Artificial Sequence
  Description of Artificial Sequence: Synthetic oligonucleotide
  Target: ATXN1; (+) strand; PAM type: YTN; PAM sequence: TTG
tgttatgaagtgccctcaca

SEQ ID NO: 307166 - DNA, 20 bp, Artificial Sequence
  Description of Artificial Sequence: Synthetic oligonucleotide
  Target: ATXN1; (+) strand; PAM type: YTN; PAM sequence: TTA
tgaagtgccctcacattggt

SEQ ID NO: 307167 - DNA, 20 bp, Artificial Sequence
  Description of Artificial Sequence: Synthetic oligonucleotide
  Target: ATXN1; (+) strand; PAM type: YTN; PAM sequence: CTC
acattggttcccaaaaatgt

SEQ ID NO: 307168 - DNA, 20 bp, Artificial Sequence
  Description of Artificial Sequence: Synthetic oligonucleotide
  Target: ATXN1; (+) strand; PAM type: YTN; PAM sequence: TTG
gttcccaaaaatgtttgcta

SEQ ID NO: 307169 - DNA, 20 bp, Artificial Sequence
  Description of Artificial Sequence: Synthetic oligonucleotide
  Target: ATXN1; (+) strand; PAM type: YTN; PAM sequence: TTC
ccaaaaatgtttgctatttt

SEQ ID NO: 307170 - DNA, 20 bp, Artificial Sequence
  Description of Artificial Sequence: Synthetic oligonucleotide
  Target: ATXN1; (+) strand; PAM type: YTN; PAM sequence: TTT
gctattttaagagccacact

SEQ ID NO: 307171 - DNA, 20 bp, Artificial Sequence
  Description of Artificial Sequence: Synthetic oligonucleotide
  Target: ATXN1; (+) strand; PAM type: YTN; PAM sequence: TTG
ctattttaagagccacacta

SEQ ID NO: 307172 - DNA, 20 bp, Artificial Sequence
  Description of Artificial Sequence: Synthetic oligonucleotide
  Target: ATXN1; (+) strand; PAM type: YTN; PAM sequence: CTA
ttttaagagccacactatta

SEQ ID NO: 307173 - DNA, 20 bp, Artificial Sequence
  Description of Artificial Sequence: Synthetic oligonucleotide
  Target: ATXN1; (+) strand; PAM type: YTN; PAM sequence: TTT
taagagccacactattaaga

SEQ ID NO: 307174 - DNA, 20 bp, Artificial Sequence
  Description of Artificial Sequence: Synthetic oligonucleotide
  Target: ATXN1; (+) strand; PAM type: YTN; PAM sequence: TTT
aagagccacactattaagaa

SEQ ID NO: 307175 - DNA, 20 bp, Artificial Sequence
  Description of Artificial Sequence: Synthetic oligonucleotide
  Target: ATXN1; (+) strand; PAM type: YTN; PAM sequence: TTA
agagccacactattaagaac

SEQ ID NO: 307176 - DNA, 20 bp, Artificial Sequence
  Description of Artificial Sequence: Synthetic oligonucleotide
  Target: ATXN1; (+) strand; PAM type: YTN; PAM sequence: CTA
ttaagaaccacaagtcagcc

SEQ ID NO: 307177 - DNA, 20 bp, Artificial Sequence
  Description of Artificial Sequence: Synthetic oligonucleotide
  Target: ATXN1; (+) strand; PAM type: YTN; PAM sequence: TTA
agaaccacaagtcagccagg

SEQ ID NO: 307178 - DNA, 20 bp, Artificial Sequence
  Description of Artificial Sequence: Synthetic oligonucleotide
  Target: ATXN1; (+) strand; PAM type: YTN; PAM sequence: CTC
atgtctgtaatcccaacact

SEQ ID NO: 307179 - DNA, 20 bp, Artificial Sequence
  Description of Artificial Sequence: Synthetic oligonucleotide
  Target: ATXN1; (+) strand; PAM type: YTN; PAM sequence: CTG
taatcccaacactttgggag

SEQ ID NO: 307180 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggagg

SEQ ID NO: 307181 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggagga

SEQ ID NO: 307182 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggaggat

SEQ ID NO: 307183 - DNA, 20 bp, Artificial Sequence
  Description of Artificial Sequence: Synthetic oligonucleotide
  Target: ATXN1; (+) strand; PAM type: YTN; PAM sequence: CTT
gaggccaagagttcgagaca

SEQ ID NO: 307184 - DNA, 20 bp, Artificial Sequence
  Description of Artificial Sequence: Synthetic oligonucleotide
  Target: ATXN1; (+) strand; PAM type: YTN; PAM sequence: TTG
aggccaagagttcgagacaa

SEQ ID NO: 307185 - DNA, 20 bp, Artificial Sequence
  Description of Artificial Sequence: Synthetic oligonucleotide
  Target: ATXN1; (+) strand; PAM type: YTN; PAM sequence: TTC
gagacaagctttggcaacat

SEQ ID NO: 307186 - DNA, 20 bp, Artificial Sequence
  Description of Artificial Sequence: Synthetic oligonucleotide
  Target: ATXN1; (+) strand; PAM type: YTN; PAM sequence: CTT
tggcaacatagcaagaccct

SEQ ID NO: 307187 - DNA, 20 bp, Artificial Sequence
  Description of Artificial Sequence: Synthetic oligonucleotide
  Target: ATXN1; (+) strand; PAM type: YTN; PAM sequence: TTT
ggcaacatagcaagaccctg

SEQ ID NO: 307188 - DNA, 20 bp, Artificial Sequence
  Description of Artificial Sequence: Synthetic oligonucleotide
  Target: ATXN1; (+) strand; PAM type: YTN; PAM sequence: TTG
gcaacatagcaagaccctgt

SEQ ID NO: 307189 - DNA, 20 bp, Artificial Sequence
  Description of Artificial Sequence: Synthetic oligonucleotide
  Target: ATXN1; (+) strand; PAM type: YTN; PAM sequence: CTG
tctctacaaaaaaattttaa

SEQ ID NO: 307190 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaaattttaaaaat

SEQ ID NO: 307191 - DNA, 20 bp, Artificial Sequence
  Description of Artificial Sequence: Synthetic oligonucleotide
  Target: ATXN1; (+) strand; PAM type: YTN; PAM sequence: CTA
caaaaaaattttaaaaatta

SEQ ID NO: 307192 - DNA, 20 bp, Artificial Sequence
  Description of Artificial Sequence: Synthetic oligonucleotide
  Target: ATXN1; (+) strand; PAM type: YTN; PAM sequence: TTT
taaaaattagttgggtgtgg

SEQ ID NO: 307193 - DNA, 20 bp, Artificial Sequence
  Description of Artificial Sequence: Synthetic oligonucleotide
  Target: ATXN1; (+) strand; PAM type: YTN; PAM sequence: TTT
aaaaattagttgggtgtggt

SEQ ID NO: 307194 - DNA, 20 bp, Artificial Sequence
  Description of Artificial Sequence: Synthetic oligonucleotide
  Target: ATXN1; (+) strand; PAM type: YTN; PAM sequence: TTA
aaaattagttgggtgtggtg

SEQ ID NO: 307195 - DNA, 20 bp, Artificial Sequence
  Description of Artificial Sequence: Synthetic oligonucleotide
  Target: ATXN1; (+) strand; PAM type: YTN; PAM sequence: TTA
gttgggtgtggtggtgcaca

SEQ ID NO: 307196 - DNA, 20 bp, Artificial Sequence
  Description of Artificial Sequence: Synthetic oligonucleotide
  Target: ATXN1; (+) strand; PAM type: YTN; PAM sequence: TTG
ggtgtggtggtgcacagcgg

SEQ ID NO: 307197 - DNA, 20 bp, Artificial Sequence
  Description of Artificial Sequence: Synthetic oligonucleotide
  Target: ATXN1; (+) strand; PAM type: YTN; PAM sequence: CTA
atcgggaggctgaggtagga

SEQ ID NO: 307198 - DNA, 20 bp, Artificial Sequence
  Description of Artificial Sequence: Synthetic oligonucleotide
  Target: ATXN1; (+) strand; PAM type: YTN; PAM sequence: CTG
aggtaggaggatcacttgag

SEQ ID NO: 307199 - DNA, 20 bp, Artificial Sequence
  Description of Artificial Sequence: Synthetic oligonucleotide
  Target: ATXN1; (+) strand; PAM type: YTN; PAM sequence: CTT
gagcccaagggttcaaggct

SEQ ID NO: 307200 - DNA, 20 bp, Artificial Sequence
  Description of Artificial Sequence: Synthetic oligonucleotide
  Target: ATXN1; (+) strand; PAM type: YTN; PAM sequence: TTG
agcccaagggttcaaggctg

SEQ ID NO: 307201 - DNA, 20 bp, Artificial Sequence
  Description of Artificial Sequence: Synthetic oligonucleotide
  Target: ATXN1; (+) strand; PAM type: YTN; PAM sequence: TTC
aaggctgcagtaaagctgtg

SEQ ID NO: 307202 - DNA, 20 bp, Artificial Sequence
  Description of Artificial Sequence: Synthetic oligonucleotide
  Target: ATXN1; (+) strand; PAM type: YTN; PAM sequence: CTG
cagtaaagctgtgatcatgc

SEQ ID NO: 307203 - DNA, 20 bp, Artificial Sequence
  Description of Artificial Sequence: Synthetic oligonucleotide
  Target: ATXN1; (+) strand; PAM type: YTN; PAM sequence: CTG
tgatcatgccactgcactcc

SEQ ID NO: 307204 - DNA, 20 bp, Artificial Sequence
  Description of Artificial Sequence: Synthetic oligonucleotide
  Target: ATXN1; (+) strand; PAM type: YTN; PAM sequence: CTG
cactccagttcggacaacag

SEQ ID NO: 307205 - DNA, 20 bp, Artificial Sequence
  Description of Artificial Sequence: Synthetic oligonucleotide
  Target: ATXN1; (+) strand; PAM type: YTN; PAM sequence: CTC
cagttcggacaacagactga

SEQ ID NO: 307206 - DNA, 20 bp, Artificial Sequence
  Description of Artificial Sequence: Synthetic oligonucleotide
  Target: ATXN1; (+) strand; PAM type: YTN; PAM sequence: TTC
ggacaacagactgagaactg

SEQ ID NO: 307207 - DNA, 20 bp, Artificial Sequence
  Description of Artificial Sequence: Synthetic oligonucleotide
  Target: ATXN1; (+) strand; PAM type: YTN; PAM sequence: CTG
agaactgacctcttggaaaa

SEQ ID NO: 307208 - DNA, 20 bp, Artificial Sequence
  Description of Artificial Sequence: Synthetic oligonucleotide
  Target: ATXN1; (+) strand; PAM type: YTN; PAM sequence: CTG
acctcttggaaaaaaaaaag

SEQ ID NO: 307209 - DNA, 20 bp, Artificial Sequence
  Description of Artificial Sequence: Synthetic oligonucleotide
  Target: ATXN1; (+) strand; PAM type: YTN; PAM sequence: CTC
ttggaaaaaaaaaagaaaca

SEQ ID NO: 307210 - DNA, 20 bp, Artificial Sequence
  Description of Artificial Sequence: Synthetic oligonucleotide
  Target: ATXN1; (+) strand; PAM type: YTN; PAM sequence: CTT
ggaaaaaaaaaagaaacagg

SEQ ID NO: 307211 - DNA, 20 bp, Artificial Sequence
  Description of Artificial Sequence: Synthetic oligonucleotide
  Target: ATXN1; (+) strand; PAM type: YTN; PAM sequence: TTG
gaaaaaaaaaagaaacaggc

SEQ ID NO: 307212 - DNA, 20 bp, Artificial Sequence
  Description of Artificial Sequence: Synthetic oligonucleotide
  Target: ATXN1; (+) strand; PAM type: YTN; PAM sequence: TTC
acacctataatcccggtact

SEQ ID NO: 307213 - DNA, 20 bp, Artificial Sequence
  Description of Artificial Sequence: Synthetic oligonucleotide
  Target: ATXN1; (+) strand; PAM type: YTN; PAM sequence: CTA
taatcccggtactttgggag

SEQ ID NO: 307214 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggtcgggag

SEQ ID NO: 307215 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggtcgggagt

SEQ ID NO: 307216 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggtcgggagtt

SEQ ID NO: 307217 - DNA, 20 bp, Artificial Sequence
  Description of Artificial Sequence: Synthetic oligonucleotide
  Target: ATXN1; (+) strand; PAM type: YTN; PAM sequence: TTC
aagaccagcttgaccaacat

SEQ ID NO: 307218 - DNA, 20 bp, Artificial Sequence
  Description of Artificial Sequence: Synthetic oligonucleotide
  Target: ATXN1; (+) strand; PAM type: YTN; PAM sequence: CTT
gaccaacatggagaaacccc

SEQ ID NO: 307219 - DNA, 20 bp, Artificial Sequence
  Description of Artificial Sequence: Synthetic oligonucleotide
  Target: ATXN1; (+) strand; PAM type: YTN; PAM sequence: TTG
accaacatggagaaacccca

SEQ ID NO: 307220 - DNA, 20 bp, Artificial Sequence
  Description of Artificial Sequence: Synthetic oligonucleotide
  Target: ATXN1; (+) strand; PAM type: YTN; PAM sequence: CTT
gactaaaaatacaaaattag

SEQ ID NO: 307221 - DNA, 20 bp, Artificial Sequence
  Description of Artificial Sequence: Synthetic oligonucleotide
  Target: ATXN1; (+) strand; PAM type: YTN; PAM sequence: TTG
actaaaaatacaaaattagc

SEQ ID NO: 307222 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaattagctggg

SEQ ID NO: 307223 - DNA, 20 bp, Artificial Sequence
  Description of Artificial Sequence: Synthetic oligonucleotide
  Target: ATXN1; (+) strand; PAM type: YTN; PAM sequence: TTA
gctgggtgtggtggcatatg

SEQ ID NO: 307224 - DNA, 20 bp, Artificial Sequence
  Description of Artificial Sequence: Synthetic oligonucleotide
  Target: ATXN1; (+) strand; PAM type: YTN; PAM sequence: CTG
ggtgtggtggcatatgcctg

SEQ ID NO: 307225 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 307226 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 307227 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 307228 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 307229 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 307230 - DNA, 20 bp, Artificial Sequence
  Description of Artificial Sequence: Synthetic oligonucleotide
  Target: ATXN1; (+) strand; PAM type: YTN; PAM sequence: CTT
gaatccgggagggagaggtt

SEQ ID NO: 307231 - DNA, 20 bp, Artificial Sequence
  Description of Artificial Sequence: Synthetic oligonucleotide
  Target: ATXN1; (+) strand; PAM type: YTN; PAM sequence: TTG
aatccgggagggagaggtta

SEQ ID NO: 307232 - DNA, 20 bp, Artificial Sequence
  Description of Artificial Sequence: Synthetic oligonucleotide
  Target: ATXN1; (+) strand; PAM type: YTN; PAM sequence: TTA
cagtgagccaagatcgtgcc

SEQ ID NO: 307233 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggcaacaa

SEQ ID NO: 307234 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaagagca

SEQ ID NO: 307235 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagcaaaactcc

SEQ ID NO: 307236 - DNA, 20 bp, Artificial Sequence
  Description of Artificial Sequence: Synthetic oligonucleotide
  Target: ATXN1; (+) strand; PAM type: YTN; PAM sequence: CTC
catctcaaatgaaaaagaac

SEQ ID NO: 307237 - DNA, 20 bp, Artificial Sequence
  Description of Artificial Sequence: Synthetic oligonucleotide
  Target: ATXN1; (+) strand; PAM type: YTN; PAM sequence: CTC
aaatgaaaaagaaccactgg

SEQ ID NO: 307238 - DNA, 20 bp, Artificial Sequence
  Description of Artificial Sequence: Synthetic oligonucleotide
  Target: ATXN1; (+) strand; PAM type: YTN; PAM sequence: CTG
gctgggtggagtggctcatg

SEQ ID NO: 307239 - DNA, 20 bp, Artificial Sequence
  Description of Artificial Sequence: Synthetic oligonucleotide
  Target: ATXN1; (+) strand; PAM type: YTN; PAM sequence: CTG
ggtggagtggctcatgcctg

SEQ ID NO: 307240 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatctcagcact

SEQ ID NO: 307241 - DNA, 20 bp, Artificial Sequence
  Description of Artificial Sequence: Synthetic oligonucleotide
  Target: ATXN1; (+) strand; PAM type: YTN; PAM sequence: CTG
taatctcagcactttgggag

SEQ ID NO: 307242 - DNA, 20 bp, Artificial Sequence
  Description of Artificial Sequence: Synthetic oligonucleotide
  Target: ATXN1; (+) strand; PAM type: YTN; PAM sequence: CTC
agcactttgggaggccaagg

SEQ ID NO: 307243 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtaggtgg

SEQ ID NO: 307244 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtaggtgga

SEQ ID NO: 307245 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtaggtggat

SEQ ID NO: 307246 - DNA, 20 bp, Artificial Sequence
  Description of Artificial Sequence: Synthetic oligonucleotide
  Target: ATXN1; (+) strand; PAM type: YTN; PAM sequence: TTT
cttgtggtcaggagttcaaa

SEQ ID NO: 307247 - DNA, 20 bp, Artificial Sequence
  Description of Artificial Sequence: Synthetic oligonucleotide
  Target: ATXN1; (+) strand; PAM type: YTN; PAM sequence: TTC
ttgtggtcaggagttcaaaa

SEQ ID NO: 307248 - DNA, 20 bp, Artificial Sequence
  Description of Artificial Sequence: Synthetic oligonucleotide
  Target: ATXN1; (+) strand; PAM type: YTN; PAM sequence: CTT
gtggtcaggagttcaaaacc

SEQ ID NO: 307249 - DNA, 20 bp, Artificial Sequence
  Description of Artificial Sequence: Synthetic oligonucleotide
  Target: ATXN1; (+) strand; PAM type: YTN; PAM sequence: TTG
tggtcaggagttcaaaacca

SEQ ID NO: 307250 - DNA, 20 bp, Artificial Sequence
  Description of Artificial Sequence: Synthetic oligonucleotide
  Target: ATXN1; (+) strand; PAM type: YTN; PAM sequence: TTC
aaaaccagcctggccaacat

SEQ ID NO: 307251 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaacccca

SEQ ID NO: 307252 - DNA, 20 bp, Artificial Sequence
  Description of Artificial Sequence: Synthetic oligonucleotide
  Target: ATXN1; (+) strand; PAM type: YTN; PAM sequence: CTC
cggaggctgacgcaggagaa

SEQ ID NO: 307253 - DNA, 20 bp, Artificial Sequence
  Description of Artificial Sequence: Synthetic oligonucleotide
  Target: ATXN1; (+) strand; PAM type: YTN; PAM sequence: CTG
acgcaggagaatcgcttgaa

SEQ ID NO: 307254 - DNA, 20 bp, Artificial Sequence
  Description of Artificial Sequence: Synthetic oligonucleotide
  Target: ATXN1; (+) strand; PAM type: YTN; PAM sequence: CTT
gaacccaagaggcggagatt

SEQ ID NO: 307255 - DNA, 20 bp, Artificial Sequence
  Description of Artificial Sequence: Synthetic oligonucleotide
  Target: ATXN1; (+) strand; PAM type: YTN; PAM sequence: TTG
aacccaagaggcggagattg

SEQ ID NO: 307256 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatctcacc

SEQ ID NO: 307257 - DNA, 20 bp, Artificial Sequence
  Description of Artificial Sequence: Synthetic oligonucleotide
  Target: ATXN1; (+) strand; PAM type: YTN; PAM sequence: CTC
accactgcactccagcctag

SEQ ID NO: 307258 - DNA, 20 bp, Artificial Sequence
  Description of Artificial Sequence: Synthetic oligonucleotide
  Target: ATXN1; (+) strand; PAM type: YTN; PAM sequence: CTG
cactccagcctaggcaaccg

SEQ ID NO: 307259 - DNA, 20 bp, Artificial Sequence
  Description of Artificial Sequence: Synthetic oligonucleotide
  Target: ATXN1; (+) strand; PAM type: YTN; PAM sequence: CTC
cagcctaggcaaccgacaga

SEQ ID NO: 307260 - DNA, 20 bp, Artificial Sequence
  Description of Artificial Sequence: Synthetic oligonucleotide
  Target: ATXN1; (+) strand; PAM type: YTN; PAM sequence: CTA
ggcaaccgacagagtgagac

SEQ ID NO: 307261 - DNA, 20 bp, Artificial Sequence
  Description of Artificial Sequence: Synthetic oligonucleotide
  Target: ATXN1; (+) strand; PAM type: YTN; PAM sequence: CTA
tagactatagagttaagatt

SEQ ID NO: 307262 - DNA, 20 bp, Artificial Sequence
  Description of Artificial Sequence: Synthetic oligonucleotide
  Target: ATXN1; (+) strand; PAM type: YTN; PAM sequence: CTA
tagagttaagatttgtgaat

SEQ ID NO: 307263 - DNA, 20 bp, Artificial Sequence
  Description of Artificial Sequence: Synthetic oligonucleotide
  Target: ATXN1; (+) strand; PAM type: YTN; PAM sequence: TTA
agatttgtgaattataacct

SEQ ID NO: 307264 - DNA, 20 bp, Artificial Sequence
  Description of Artificial Sequence: Synthetic oligonucleotide
  Target: ATXN1; (+) strand; PAM type: YTN; PAM sequence: TTT
gtgaattataacctgacaag

SEQ ID NO: 307265 - DNA, 20 bp, Artificial Sequence
  Description of Artificial Sequence: Synthetic oligonucleotide
  Target: ATXN1; (+) strand; PAM type: YTN; PAM sequence: TTG
tgaattataacctgacaagc

SEQ ID NO: 307266 - DNA, 20 bp, Artificial Sequence
  Description of Artificial Sequence: Synthetic oligonucleotide
  Target: ATXN1; (+) strand; PAM type: YTN; PAM sequence: TTA
taacctgacaagcttgtgag

SEQ ID NO: 307267 - DNA, 20 bp, Artificial Sequence
  Description of Artificial Sequence: Synthetic oligonucleotide
  Target: ATXN1; (+) strand; PAM type: YTN; PAM sequence: CTG
acaagcttgtgagagatctg

SEQ ID NO: 307268 - DNA, 20 bp, Artificial Sequence
  Description of Artificial Sequence: Synthetic oligonucleotide
  Target: ATXN1; (+) strand; PAM type: YTN; PAM sequence: CTT
gtgagagatctgttggcaca

SEQ ID NO: 307269 - DNA, 20 bp, Artificial Sequence
  Description of Artificial Sequence: Synthetic oligonucleotide
  Target: ATXN1; (+) strand; PAM type: YTN; PAM sequence: TTG
tgagagatctgttggcacag

SEQ ID NO: 307270 - DNA, 20 bp, Artificial Sequence
  Description of Artificial Sequence: Synthetic oligonucleotide
  Target: ATXN1; (+) strand; PAM type: YTN; PAM sequence: CTG
ttggcacagtcatatgaaat

SEQ ID NO: 307271 - DNA, 20 bp, Artificial Sequence
  Description of Artificial Sequence: Synthetic oligonucleotide
  Target: ATXN1; (+) strand; PAM type: YTN; PAM sequence: TTG
gcacagtcatatgaaatcat

SEQ ID NO: 307272 - DNA, 20 bp, Artificial Sequence
  Description of Artificial Sequence: Synthetic oligonucleotide
  Target: ATXN1; (+) strand; PAM type: YTN; PAM sequence: CTT
ctcaggtgttctgtttgcta

SEQ ID NO: 307273 - DNA, 20 bp, Artificial Sequence
  Description of Artificial Sequence: Synthetic oligonucleotide
  Target: ATXN1; (+) strand; PAM type: YTN; PAM sequence: TTC
tcaggtgttctgtttgctac

SEQ ID NO: 307274 - DNA, 20 bp, Artificial Sequence
  Description of Artificial Sequence: Synthetic oligonucleotide
  Target: ATXN1; (+) strand; PAM type: YTN; PAM sequence: CTC
aggtgttctgtttgctacaa

SEQ ID NO: 307275 - DNA, 20 bp, Artificial Sequence
  Description of Artificial Sequence: Synthetic oligonucleotide
  Target: ATXN1; (+) strand; PAM type: YTN; PAM sequence: TTC
tgtttgctacaaaacatagc

SEQ ID NO: 307276 - DNA, 20 bp, Artificial Sequence
  Description of Artificial Sequence: Synthetic oligonucleotide
  Target: ATXN1; (+) strand; PAM type: YTN; PAM sequence: CTG
tttgctacaaaacatagcat

SEQ ID NO: 307277 - DNA, 20 bp, Artificial Sequence
  Description of Artificial Sequence: Synthetic oligonucleotide
  Target: ATXN1; (+) strand; PAM type: YTN; PAM sequence: TTT
gctacaaaacatagcatgct

SEQ ID NO: 307278 - DNA, 20 bp, Artificial Sequence
  Description of Artificial Sequence: Synthetic oligonucleotide
  Target: ATXN1; (+) strand; PAM type: YTN; PAM sequence: TTG
ctacaaaacatagcatgctt

SEQ ID NO: 307279 - DNA, 20 bp, Artificial Sequence
  Description of Artificial Sequence: Synthetic oligonucleotide
  Target: ATXN1; (+) strand; PAM type: YTN; PAM sequence: CTA
caaaacatagcatgctttac

SEQ ID NO: 307280 - DNA, 20 bp, Artificial Sequence
  Description of Artificial Sequence: Synthetic oligonucleotide
  Target: ATXN1; (+) strand; PAM type: YTN; PAM sequence: CTT
tacttggaagggcatgcctc

SEQ ID NO: 307281 - DNA, 20 bp, Artificial Sequence
  Description of Artificial Sequence: Synthetic oligonucleotide
  Target: ATXN1; (+) strand; PAM type: YTN; PAM sequence: TTT
acttggaagggcatgcctca

SEQ ID NO: 307282 - DNA, 20 bp, Artificial Sequence
  Description of Artificial Sequence: Synthetic oligonucleotide
  Target: ATXN1; (+) strand; PAM type: YTN; PAM sequence: TTA
cttggaagggcatgcctcat

SEQ ID NO: 307283 - DNA, 20 bp, Artificial Sequence
  Description of Artificial Sequence: Synthetic oligonucleotide
  Target: ATXN1; (+) strand; PAM type: YTN; PAM sequence: CTT
ggaagggcatgcctcatttg

SEQ ID NO: 307284 - DNA, 20 bp, Artificial Sequence
  Description of Artificial Sequence: Synthetic oligonucleotide
  Target: ATXN1; (+) strand; PAM type: YTN; PAM sequence: TTG
gaagggcatgcctcatttga

SEQ ID NO: 307285 - DNA, 20 bp, Artificial Sequence
  Description of Artificial Sequence: Synthetic oligonucleotide
  Target: ATXN1; (+) strand; PAM type: YTN; PAM sequence: CTC
atttgagtgaggcaaaaata

SEQ ID NO: 307286 - DNA, 20 bp, Artificial Sequence
  Description of Artificial Sequence: Synthetic oligonucleotide
  Target: ATXN1; (+) strand; PAM type: YTN; PAM sequence: TTT
gagtgaggcaaaaatattgt

SEQ ID NO: 307287 - DNA, 20 bp, Artificial Sequence
  Description of Artificial Sequence: Synthetic oligonucleotide
  Target: ATXN1; (+) strand; PAM type: YTN; PAM sequence: TTG
agtgaggcaaaaatattgtc

SEQ ID NO: 307288 - DNA, 20 bp, Artificial Sequence
  Description of Artificial Sequence: Synthetic oligonucleotide
  Target: ATXN1; (+) strand; PAM type: YTN; PAM sequence: TTG
tcatctcaccaagaattccc

SEQ ID NO: 307289 - DNA, 20 bp, Artificial Sequence
  Description of Artificial Sequence: Synthetic oligonucleotide
  Target: ATXN1; (+) strand; PAM type: YTN; PAM sequence: CTC
accaagaattcccaacacta

SEQ ID NO: 307290 - DNA, 20 bp, Artificial Sequence
  Description of Artificial Sequence: Synthetic oligonucleotide
  Target: ATXN1; (+) strand; PAM type: YTN; PAM sequence: TTC
ccaacactagtcatgacact

SEQ ID NO: 307291 - DNA, 20 bp, Artificial Sequence
  Description of Artificial Sequence: Synthetic oligonucleotide
  Target: ATXN1; (+) strand; PAM type: YTN; PAM sequence: CTA
gtcatgacactgggcatccc

SEQ ID NO: 307292 - DNA, 20 bp, Artificial Sequence
  Description of Artificial Sequence: Synthetic oligonucleotide
  Target: ATXN1; (+) strand; PAM type: YTN; PAM sequence: CTG
ggcatccccgcaaggaacgc

SEQ ID NO: 307293 - DNA, 20 bp, Artificial Sequence
  Description of Artificial Sequence: Synthetic oligonucleotide
  Target: ATXN1; (+) strand; PAM type: YTN; PAM sequence: CTC
gccttcactttttaaaggtt

SEQ ID NO: 307294 - DNA, 20 bp, Artificial Sequence
  Description of Artificial Sequence: Synthetic oligonucleotide
  Target: ATXN1; (+) strand; PAM type: YTN; PAM sequence: CTT
cactttttaaaggtttgttc

SEQ ID NO: 307295 - DNA, 20 bp, Artificial Sequence
  Description of Artificial Sequence: Synthetic oligonucleotide
  Target: ATXN1; (+) strand; PAM type: YTN; PAM sequence: TTC
actttttaaaggtttgttct

SEQ ID NO: 307296 - DNA, 20 bp, Artificial Sequence
  Description of Artificial Sequence: Synthetic oligonucleotide
  Target: ATXN1; (+) strand; PAM type: YTN; PAM sequence: CTT
tttaaaggtttgttctgacc

SEQ ID NO: 307297 - DNA, 20 bp, Artificial Sequence
  Description of Artificial Sequence: Synthetic oligonucleotide
  Target: ATXN1; (+) strand; PAM type: YTN; PAM sequence: TTT
ttaaaggtttgttctgaccc

SEQ ID NO: 307298 - DNA, 20 bp, Artificial Sequence
  Description of Artificial Sequence: Synthetic oligonucleotide
  Target: ATXN1; (+) strand; PAM type: YTN; PAM sequence: TTT
taaaggtttgttctgaccca

SEQ ID NO: 307299 - DNA, 20 bp, Artificial Sequence
  Description of Artificial Sequence: Synthetic oligonucleotide
  Target: ATXN1; (+) strand; PAM type: YTN; PAM sequence: TTT
aaaggtttgttctgacccag

SEQ ID NO: 307300 - DNA, 20 bp, Artificial Sequence
  Description of Artificial Sequence: Synthetic oligonucleotide
  Target: ATXN1; (+) strand; PAM type: YTN; PAM sequence: TTA
aaggtttgttctgacccagt

SEQ ID NO: 307301 - DNA, 20 bp, Artificial Sequence
  Description of Artificial Sequence: Synthetic oligonucleotide
  Target: ATXN1; (+) strand; PAM type: YTN; PAM sequence: TTT
gttctgacccagttcttctt

SEQ ID NO: 307302 - DNA, 20 bp, Artificial Sequence
  Description of Artificial Sequence: Synthetic oligonucleotide
  Target: ATXN1; (+) strand; PAM type: YTN; PAM sequence: TTG
ttctgacccagttcttcttt

SEQ ID NO: 307303 - DNA, 20 bp, Artificial Sequence
  Description of Artificial Sequence: Synthetic oligonucleotide
  Target: ATXN1; (+) strand; PAM type: YTN; PAM sequence: TTC
tgacccagttcttctttgtt

SEQ ID NO: 307304 - DNA, 20 bp, Artificial Sequence
  Description of Artificial Sequence: Synthetic oligonucleotide
  Target: ATXN1; (+) strand; PAM type: YTN; PAM sequence: CTG
acccagttcttctttgttct

SEQ ID NO: 307305 - DNA, 20 bp, Artificial Sequence
  Description of Artificial Sequence: Synthetic oligonucleotide
  Target: ATXN1; (+) strand; PAM type: YTN; PAM sequence: TTC
ttctttgttctccatgatgg

SEQ ID NO: 307306 - DNA, 20 bp, Artificial Sequence
  Description of Artificial Sequence: Synthetic oligonucleotide
  Target: ATXN1; (+) strand; PAM type: YTN; PAM sequence: CTT
ctttgttctccatgatggtg

SEQ ID NO: 307307 - DNA, 20 bp, Artificial Sequence
  Description of Artificial Sequence: Synthetic oligonucleotide
  Target: ATXN1; (+) strand; PAM type: YTN; PAM sequence: TTC
tttgttctccatgatggtgc

SEQ ID NO: 307308 - DNA, 20 bp, Artificial Sequence
  Description of Artificial Sequence: Synthetic oligonucleotide
  Target: ATXN1; (+) strand; PAM type: YTN; PAM sequence: CTT
tgttctccatgatggtgcga

SEQ ID NO: 307309 - DNA, 20 bp, Artificial Sequence
  Description of Artificial Sequence: Synthetic oligonucleotide
  Target: ATXN1; (+) strand; PAM type: YTN; PAM sequence: TTT
gttctccatgatggtgcgag

SEQ ID NO: 307310 - DNA, 20 bp, Artificial Sequence
  Description of Artificial Sequence: Synthetic oligonucleotide
  Target: ATXN1; (+) strand; PAM type: YTN; PAM sequence: TTG
ttctccatgatggtgcgaga

SEQ ID NO: 307311 - DNA, 20 bp, Artificial Sequence
  Description of Artificial Sequence: Synthetic oligonucleotide
  Target: ATXN1; (+) strand; PAM type: YTN; PAM sequence: TTC
tccatgatggtgcgagaaaa

SEQ ID NO: 307312 - DNA, 20 bp, Artificial Sequence
  Description of Artificial Sequence: Synthetic oligonucleotide
  Target: ATXN1; (+) strand; PAM type: YTN; PAM sequence: CTC
catgatggtgcgagaaaaga

SEQ ID NO: 307313 - DNA, 20 bp, Artificial Sequence
  Description of Artificial Sequence: Synthetic oligonucleotide
  Target: ATXN1; (+) strand; PAM type: YTN; PAM sequence: CTG
gctggtgtgcatttttgtgt

SEQ ID NO: 307314 - DNA, 20 bp, Artificial Sequence
  Description of Artificial Sequence: Synthetic oligonucleotide
  Target: ATXN1; (+) strand; PAM type: YTN; PAM sequence: CTG
gtgtgcatttttgtgtactt

SEQ ID NO: 307315 - DNA, 20 bp, Artificial Sequence
  Description of Artificial Sequence: Synthetic oligonucleotide
  Target: ATXN1; (+) strand; PAM type: YTN; PAM sequence: TTT
ttgtgtactttcgtgaaaaa

SEQ ID NO: 307316 - DNA, 20 bp, Artificial Sequence
  Description of Artificial Sequence: Synthetic oligonucleotide
  Target: ATXN1; (+) strand; PAM type: YTN; PAM sequence: TTT
tgtgtactttcgtgaaaaat

SEQ ID NO: 307317 - DNA, 20 bp, Artificial Sequence
  Description of Artificial Sequence: Synthetic oligonucleotide
  Target: ATXN1; (+) strand; PAM type: YTN; PAM sequence: TTT
gtgtactttcgtgaaaaata

SEQ ID NO: 307318 - DNA, 20 bp, Artificial Sequence
  Description of Artificial Sequence: Synthetic oligonucleotide
  Target: ATXN1; (+) strand; PAM type: YTN; PAM sequence: TTG
tgtactttcgtgaaaaatat

SEQ ID NO: 307319 - DNA, 20 bp, Artificial Sequence
  Description of Artificial Sequence: Synthetic oligonucleotide
  Target: ATXN1; (+) strand; PAM type: YTN; PAM sequence: CTT
tcgtgaaaaatatatgtata

SEQ ID NO: 307320 - DNA, 20 bp, Artificial Sequence
  Description of Artificial Sequence: Synthetic oligonucleotide
  Target: ATXN1; (+) strand; PAM type: YTN; PAM sequence: TTT
cgtgaaaaatatatgtatac

SEQ ID NO: 307321 - DNA, 20 bp, Artificial Sequence
  Description of Artificial Sequence: Synthetic oligonucleotide
  Target: ATXN1; (+) strand; PAM type: YTN; PAM sequence: TTC
gtgaaaaatatatgtatact

SEQ ID NO: 307322 - DNA, 20 bp, Artificial Sequence
  Description of Artificial Sequence: Synthetic oligonucleotide
  Target: ATXN1; (+) strand; PAM type: YTN; PAM sequence: CTT
ttttgagatggagtctcact

SEQ ID NO: 307323 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtctcactc

SEQ ID NO: 307324 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtctcactct

SEQ ID NO: 307325 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtctcactctg

SEQ ID NO: 307326 - DNA, 20 bp, Artificial Sequence
  Description of Artificial Sequence: Synthetic oligonucleotide
  Target: ATXN1; (+) strand; PAM type: YTN; PAM sequence: TTT
gagatggagtctcactctgt

SEQ ID NO: 307327 - DNA, 20 bp, Artificial Sequence
  Description of Artificial Sequence: Synthetic oligonucleotide
  Target: ATXN1; (+) strand; PAM type: YTN; PAM sequence: TTG
agatggagtctcactctgtc

SEQ ID NO: 307328 - DNA, 20 bp, Artificial Sequence
  Description of Artificial Sequence: Synthetic oligonucleotide
  Target: ATXN1; (+) strand; PAM type: YTN; PAM sequence: CTC
actctgtcgctcaggctgga

SEQ ID NO: 307329 - DNA, 20 bp, Artificial Sequence
  Description of Artificial Sequence: Synthetic oligonucleotide
  Target: ATXN1; (+) strand; PAM type: YTN; PAM sequence: CTC
tgtcgctcaggctggagtgt

SEQ ID NO: 307330 - DNA, 20 bp, Artificial Sequence
  Description of Artificial Sequence: Synthetic oligonucleotide
  Target: ATXN1; (+) strand; PAM type: YTN; PAM sequence: CTG
tcgctcaggctggagtgtag

SEQ ID NO: 307331 - DNA, 20 bp, Artificial Sequence
  Description of Artificial Sequence: Synthetic oligonucleotide
  Target: ATXN1; (+) strand; PAM type: YTN; PAM sequence: CTC
aggctggagtgtagtggtgc

SEQ ID NO: 307332 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtggtgcaatctc

SEQ ID NO: 307333 - DNA, 20 bp, Artificial Sequence
  Description of Artificial Sequence: Synthetic oligonucleotide
  Target: ATXN1; (+) strand; PAM type: YTN; PAM sequence: CTC
agctcactgcagcctcgacc

SEQ ID NO: 307334 - DNA, 20 bp, Artificial Sequence
  Description of Artificial Sequence: Synthetic oligonucleotide
  Target: ATXN1; (+) strand; PAM type: YTN; PAM sequence: CTC
actgcagcctcgacctccca

SEQ ID NO: 307335 - DNA, 20 bp, Artificial Sequence
  Description of Artificial Sequence: Synthetic oligonucleotide
  Target: ATXN1; (+) strand; PAM type: YTN; PAM sequence: CTG
cagcctcgacctcccaggtt

SEQ ID NO: 307336 - DNA, 20 bp, Artificial Sequence
  Description of Artificial Sequence: Synthetic oligonucleotide
  Target: ATXN1; (+) strand; PAM type: YTN; PAM sequence: CTC
gacctcccaggttcaagcaa

SEQ ID NO: 307337 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagcaattctcc

SEQ ID NO: 307338 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgcctcag

SEQ ID NO: 307339 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcctgag

SEQ ID NO: 307340 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcctgagta

SEQ ID NO: 307341 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagcg

SEQ ID NO: 307342 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagcgggga

SEQ ID NO: 307343 - DNA, 20 bp, Artificial Sequence
  Description of Artificial Sequence: Synthetic oligonucleotide
  Target: ATXN1; (+) strand; PAM type: YTN; PAM sequence: CTC
ctgagtagcggggaccacag

SEQ ID NO: 307344 - DNA, 20 bp, Artificial Sequence
  Description of Artificial Sequence: Synthetic oligonucleotide
  Target: ATXN1; (+) strand; PAM type: YTN; PAM sequence: CTG
agtagcggggaccacaggcg

SEQ ID NO: 307345 - DNA, 20 bp, Artificial Sequence
  Description of Artificial Sequence: Synthetic oligonucleotide
  Target: ATXN1; (+) strand; PAM type: YTN; PAM sequence: CTA
atttttgtattttagtaaag

SEQ ID NO: 307346 - DNA, 20 bp, Artificial Sequence
  Description of Artificial Sequence: Synthetic oligonucleotide
  Target: ATXN1; (+) strand; PAM type: YTN; PAM sequence: TTT
ttgtattttagtaaagacag

SEQ ID NO: 307347 - DNA, 20 bp, Artificial Sequence
  Description of Artificial Sequence: Synthetic oligonucleotide
  Target: ATXN1; (+) strand; PAM type: YTN; PAM sequence: TTT
tgtattttagtaaagacagg

SEQ ID NO: 307348 - DNA, 20 bp, Artificial Sequence
  Description of Artificial Sequence: Synthetic oligonucleotide
  Target: ATXN1; (+) strand; PAM type: YTN; PAM sequence: TTT
gtattttagtaaagacagga

SEQ ID NO: 307349 - DNA, 20 bp, Artificial Sequence
  Description of Artificial Sequence: Synthetic oligonucleotide
  Target: ATXN1; (+) strand; PAM type: YTN; PAM sequence: TTG
tattttagtaaagacaggat

SEQ ID NO: 307350 - DNA, 20 bp, Artificial Sequence
  Description of Artificial Sequence: Synthetic oligonucleotide
  Target: ATXN1; (+) strand; PAM type: YTN; PAM sequence: TTT
tagtaaagacaggattttac

SEQ ID NO: 307351 - DNA, 20 bp, Artificial Sequence
  Description of Artificial Sequence: Synthetic oligonucleotide
  Target: ATXN1; (+) strand; PAM type: YTN; PAM sequence: TTT
agtaaagacaggattttacc

SEQ ID NO: 307352 - DNA, 20 bp, Artificial Sequence
  Description of Artificial Sequence: Synthetic oligonucleotide
  Target: ATXN1; (+) strand; PAM type: YTN; PAM sequence: TTA
gtaaagacaggattttacca

SEQ ID NO: 307353 - DNA, 20 bp, Artificial Sequence
  Description of Artificial Sequence: Synthetic oligonucleotide
  Target: ATXN1; (+) strand; PAM type: YTN; PAM sequence: TTT
taccatgttggtcaggctgg

SEQ ID NO: 307354 - DNA, 20 bp, Artificial Sequence
  Description of Artificial Sequence: Synthetic oligonucleotide
  Target: ATXN1; (+) strand; PAM type: YTN; PAM sequence: TTT
accatgttggtcaggctggt

SEQ ID NO: 307355 - DNA, 20 bp, Artificial Sequence
  Description of Artificial Sequence: Synthetic oligonucleotide
  Target: ATXN1; (+) strand; PAM type: YTN; PAM sequence: TTA
ccatgttggtcaggctggtc

SEQ ID NO: 307356 - DNA, 20 bp, Artificial Sequence
  Description of Artificial Sequence: Synthetic oligonucleotide
  Target: ATXN1; (+) strand; PAM type: YTN; PAM sequence: TTG
gtcaggctggtctcgaacta

SEQ ID NO: 307357 - DNA, 20 bp, Artificial Sequence
  Description of Artificial Sequence: Synthetic oligonucleotide
  Target: ATXN1; (+) strand; PAM type: YTN; PAM sequence: CTG
gtctcgaactatggacctca

SEQ ID NO: 307358 - DNA, 20 bp, Artificial Sequence
  Description of Artificial Sequence: Synthetic oligonucleotide
  Target: ATXN1; (+) strand; PAM type: YTN; PAM sequence: CTC
gaactatggacctcaaataa

SEQ ID NO: 307359 - DNA, 20 bp, Artificial Sequence
  Description of Artificial Sequence: Synthetic oligonucleotide
  Target: ATXN1; (+) strand; PAM type: YTN; PAM sequence: CTA
tggacctcaaataatccacc

SEQ ID NO: 307360 - DNA, 20 bp, Artificial Sequence
  Description of Artificial Sequence: Synthetic oligonucleotide
  Target: ATXN1; (+) strand; PAM type: YTN; PAM sequence: CTC
aaataatccacctgccttgg

SEQ ID NO: 307361 - DNA, 20 bp, Artificial Sequence
  Description of Artificial Sequence: Synthetic oligonucleotide
  Target: ATXN1; (+) strand; PAM type: YTN; PAM sequence: CTG
ccttggcctctcaaagtgct

SEQ ID NO: 307362 - DNA, 20 bp, Artificial Sequence
  Description of Artificial Sequence: Synthetic oligonucleotide
  Target: ATXN1; (+) strand; PAM type: YTN; PAM sequence: CTT
ggcctctcaaagtgctggga

SEQ ID NO: 307363 - DNA, 20 bp, Artificial Sequence
  Description of Artificial Sequence: Synthetic oligonucleotide
  Target: ATXN1; (+) strand; PAM type: YTN; PAM sequence: TTG
gcctctcaaagtgctgggat

SEQ ID NO: 307364 - DNA, 20 bp, Artificial Sequence
  Description of Artificial Sequence: Synthetic oligonucleotide
  Target: ATXN1; (+) strand; PAM type: YTN; PAM sequence: CTC
tcaaagtgctgggattacag

SEQ ID NO: 307365 - DNA, 20 bp, Artificial Sequence
  Description of Artificial Sequence: Synthetic oligonucleotide
  Target: ATXN1; (+) strand; PAM type: YTN; PAM sequence: CTC
aaagtgctgggattacagac

SEQ ID NO: 307366 - DNA, 20 bp, Artificial Sequence
  Description of Artificial Sequence: Synthetic oligonucleotide
  Target: ATXN1; (+) strand; PAM type: YTN; PAM sequence: CTG
ggattacagacgtgagccac

SEQ ID NO: 307367 - DNA, 20 bp, Artificial Sequence
  Description of Artificial Sequence: Synthetic oligonucleotide
  Target: ATXN1; (+) strand; PAM type: YTN; PAM sequence: TTA
cagacgtgagccaccgtgcc

SEQ ID NO: 307368 - DNA, 20 bp, Artificial Sequence
  Description of Artificial Sequence: Synthetic oligonucleotide
  Target: ATXN1; (+) strand; PAM type: YTN; PAM sequence: CTA
gtcttaaaaatattttaaaa

SEQ ID NO: 307369 - DNA, 20 bp, Artificial Sequence
  Description of Artificial Sequence: Synthetic oligonucleotide
  Target: ATXN1; (+) strand; PAM type: YTN; PAM sequence: CTT
aaaaatattttaaaacgtca

SEQ ID NO: 307370 - DNA, 20 bp, Artificial Sequence
  Description of Artificial Sequence: Synthetic oligonucleotide
  Target: ATXN1; (+) strand; PAM type: YTN; PAM sequence: TTA
aaaatattttaaaacgtcat

SEQ ID NO: 307371 - DNA, 20 bp, Artificial Sequence
  Description of Artificial Sequence: Synthetic oligonucleotide
  Target: ATXN1; (+) strand; PAM type: YTN; PAM sequence: TTT
taaaacgtcatgtttctata

SEQ ID NO: 307372 - DNA, 20 bp, Artificial Sequence
  Description of Artificial Sequence: Synthetic oligonucleotide
  Target: ATXN1; (+) strand; PAM type: YTN; PAM sequence: TTT
aaaacgtcatgtttctatag

SEQ ID NO: 307373 - DNA, 20 bp, Artificial Sequence
  Description of Artificial Sequence: Synthetic oligonucleotide
  Target: ATXN1; (+) strand; PAM type: YTN; PAM sequence: TTA
aaacgtcatgtttctatagt

SEQ ID NO: 307374 - DNA, 20 bp, Artificial Sequence
  Description of Artificial Sequence: Synthetic oligonucleotide
  Target: ATXN1; (+) strand; PAM type: YTN; PAM sequence: TTT
ctatagtggttccttctgag

SEQ ID NO: 307375 - DNA, 20 bp, Artificial Sequence
  Description of Artificial Sequence: Synthetic oligonucleotide
  Target: ATXN1; (+) strand; PAM type: YTN; PAM sequence: TTC
tatagtggttccttctgagg

SEQ ID NO: 307376 - DNA, 20 bp, Artificial Sequence
  Description of Artificial Sequence: Synthetic oligonucleotide
  Target: ATXN1; (+) strand; PAM type: YTN; PAM sequence: CTA
tagtggttccttctgaggtg

SEQ ID NO: 307377 - DNA, 20 bp, Artificial Sequence
  Description of Artificial Sequence: Synthetic oligonucleotide
  Target: ATXN1; (+) strand; PAM type: YTN; PAM sequence: TTC
cttctgaggtgggaagaatg

SEQ ID NO: 307378 - DNA, 20 bp, Artificial Sequence
  Description of Artificial Sequence: Synthetic oligonucleotide
  Target: ATXN1; (+) strand; PAM type: YTN; PAM sequence: CTT
ctgaggtgggaagaatgtga

SEQ ID NO: 307379 - DNA, 20 bp, Artificial Sequence
  Description of Artificial Sequence: Synthetic oligonucleotide
  Target: ATXN1; (+) strand; PAM type: YTN; PAM sequence: TTC
tgaggtgggaagaatgtgac

SEQ ID NO: 307380 - DNA, 20 bp, Artificial Sequence
  Description of Artificial Sequence: Synthetic oligonucleotide
  Target: ATXN1; (+) strand; PAM type: YTN; PAM sequence: CTG
aggtgggaagaatgtgacaa

SEQ ID NO: 307381 - DNA, 20 bp, Artificial Sequence
  Description of Artificial Sequence: Synthetic oligonucleotide
  Target: ATXN1; (+) strand; PAM type: YTN; PAM sequence: TTG
gggaggtccacatagaggac

SEQ ID NO: 307382 - DNA, 20 bp, Artificial Sequence
  Description of Artificial Sequence: Synthetic oligonucleotide
  Target: ATXN1; (+) strand; PAM type: YTN; PAM sequence: TTG
atggtaattttaaaatatgg

SEQ ID NO: 307383 - DNA, 20 bp, Artificial Sequence
  Description of Artificial Sequence: Synthetic oligonucleotide
  Target: ATXN1; (+) strand; PAM type: YTN; PAM sequence: TTT
taaaatatgggtgtagagtt

SEQ ID NO: 307384 - DNA, 20 bp, Artificial Sequence
  Description of Artificial Sequence: Synthetic oligonucleotide
  Target: ATXN1; (+) strand; PAM type: YTN; PAM sequence: TTT
aaaatatgggtgtagagtta

SEQ ID NO: 307385 - DNA, 20 bp, Artificial Sequence
  Description of Artificial Sequence: Synthetic oligonucleotide
  Target: ATXN1; (+) strand; PAM type: YTN; PAM sequence: TTA
aaatatgggtgtagagttaa

SEQ ID NO: 307386 - DNA, 20 bp, Artificial Sequence
  Description of Artificial Sequence: Synthetic oligonucleotide
  Target: ATXN1; (+) strand; PAM type: YTN; PAM sequence: TTA
aaggagtgttcactgaaccc

SEQ ID NO: 307387 - DNA, 20 bp, Artificial Sequence
  Description of Artificial Sequence: Synthetic oligonucleotide
  Target: ATXN1; (+) strand; PAM type: YTN; PAM sequence: TTC
actgaacccttattttttat

SEQ ID NO: 307388 - DNA, 20 bp, Artificial Sequence
  Description of Artificial Sequence: Synthetic oligonucleotide
  Target: ATXN1; (+) strand; PAM type: YTN; PAM sequence: CTG
aacccttattttttataatt

SEQ ID NO: 307389 - DNA, 20 bp, Artificial Sequence
  Description of Artificial Sequence: Synthetic oligonucleotide
  Target: ATXN1; (+) strand; PAM type: YTN; PAM sequence: CTT
attttttataatttacattt

SEQ ID NO: 307390 - DNA, 20 bp, Artificial Sequence
  Description of Artificial Sequence: Synthetic oligonucleotide
  Target: ATXN1; (+) strand; PAM type: YTN; PAM sequence: TTA
ttttttataatttacattta

SEQ ID NO: 307391 - DNA, 20 bp, Artificial Sequence
  Description of Artificial Sequence: Synthetic oligonucleotide
  Target: ATXN1; (+) strand; PAM type: YTN; PAM sequence: TTT
tttataatttacatttattt

SEQ ID NO: 307392 - DNA, 20 bp, Artificial Sequence
  Description of Artificial Sequence: Synthetic oligonucleotide
  Target: ATXN1; (+) strand; PAM type: YTN; PAM sequence: TTT
ttataatttacatttatttt

SEQ ID NO: 307393 - DNA, 20 bp, Artificial Sequence
  Description of Artificial Sequence: Synthetic oligonucleotide
  Target: ATXN1; (+) strand; PAM type: YTN; PAM sequence: TTT
tataatttacatttattttg

SEQ ID NO: 307394 - DNA, 20 bp, Artificial Sequence
  Description of Artificial Sequence: Synthetic oligonucleotide
  Target: ATXN1; (+) strand; PAM type: YTN; PAM sequence: TTT
ataatttacatttattttgt

SEQ ID NO: 307395 - DNA, 20 bp, Artificial Sequence
  Description of Artificial Sequence: Synthetic oligonucleotide
  Target: ATXN1; (+) strand; PAM type: YTN; PAM sequence: TTA
taatttacatttattttgtg

SEQ ID NO: 307396 - DNA, 20 bp, Artificial Sequence
  Description of Artificial Sequence: Synthetic oligonucleotide
  Target: ATXN1; (+) strand; PAM type: YTN; PAM sequence: TTT
acatttattttgtgaatata

SEQ ID NO: 307397 - DNA, 20 bp, Artificial Sequence
  Description of Artificial Sequence: Synthetic oligonucleotide
  Target: ATXN1; (+) strand; PAM type: YTN; PAM sequence: TTA
catttattttgtgaatatac

SEQ ID NO: 307398 - DNA, 20 bp, Artificial Sequence
  Description of Artificial Sequence: Synthetic oligonucleotide
  Target: ATXN1; (+) strand; PAM type: YTN; PAM sequence: TTT
attttgtgaatatacttttg

SEQ ID NO: 307399 - DNA, 20 bp, Artificial Sequence
  Description of Artificial Sequence: Synthetic oligonucleotide
  Target: ATXN1; (+) strand; PAM type: YTN; PAM sequence: TTA
ttttgtgaatatacttttgt

SEQ ID NO: 307400 - DNA, 20 bp, Artificial Sequence
  Description of Artificial Sequence: Synthetic oligonucleotide
  Target: ATXN1; (+) strand; PAM type: YTN; PAM sequence: TTT
tgtgaatatacttttgtatt

SEQ ID NO: 307401 - DNA, 20 bp, Artificial Sequence
  Description of Artificial Sequence: Synthetic oligonucleotide
  Target: ATXN1; (+) strand; PAM type: YTN; PAM sequence: TTT
gtgaatatacttttgtattt

SEQ ID NO: 307402 - DNA, 20 bp, Artificial Sequence
  Description of Artificial Sequence: Synthetic oligonucleotide
  Target: ATXN1; (+) strand; PAM type: YTN; PAM sequence: TTG
tgaatatacttttgtatttc

SEQ ID NO: 307403 - DNA, 20 bp, Artificial Sequence
  Description of Artificial Sequence: Synthetic oligonucleotide
  Target: ATXN1; (+) strand; PAM type: YTN; PAM sequence: CTT
ttgtatttctattttactgt

SEQ ID NO: 307404 - DNA, 20 bp, Artificial Sequence
  Description of Artificial Sequence: Synthetic oligonucleotide
  Target: ATXN1; (+) strand; PAM type: YTN; PAM sequence: TTT
tgtatttctattttactgta

SEQ ID NO: 307405 - DNA, 20 bp, Artificial Sequence
  Description of Artificial Sequence: Synthetic oligonucleotide
  Target: ATXN1; (+) strand; PAM type: YTN; PAM sequence: TTT
gtatttctattttactgtat

SEQ ID NO: 307406 - DNA, 20 bp, Artificial Sequence
  Description of Artificial Sequence: Synthetic oligonucleotide
  Target: ATXN1; (+) strand; PAM type: YTN; PAM sequence: TTG
tatttctattttactgtatt

SEQ ID NO: 307407 - DNA, 20 bp, Artificial Sequence
  Description of Artificial Sequence: Synthetic oligonucleotide
  Target: ATXN1; (+) strand; PAM type: YTN; PAM sequence: TTT
ctattttactgtattttatt

SEQ ID NO: 307408 - DNA, 20 bp, Artificial Sequence
  Description of Artificial Sequence: Synthetic oligonucleotide
  Target: ATXN1; (+) strand; PAM type: YTN; PAM sequence: TTC
tattttactgtattttattt

SEQ ID NO: 307409 - DNA, 20 bp, Artificial Sequence
  Description of Artificial Sequence: Synthetic oligonucleotide
  Target: ATXN1; (+) strand; PAM type: YTN; PAM sequence: CTA
ttttactgtattttatttta

SEQ ID NO: 307410 - DNA, 20 bp, Artificial Sequence
  Description of Artificial Sequence: Synthetic oligonucleotide
  Target: ATXN1; (+) strand; PAM type: YTN; PAM sequence: TTT
tactgtattttattttatat

SEQ ID NO: 307411 - DNA, 20 bp, Artificial Sequence
  Description of Artificial Sequence: Synthetic oligonucleotide
  Target: ATXN1; (+) strand; PAM type: YTN; PAM sequence: TTT
actgtattttattttatatt

SEQ ID NO: 307412 - DNA, 20 bp, Artificial Sequence
  Description of Artificial Sequence: Synthetic oligonucleotide
  Target: ATXN1; (+) strand; PAM type: YTN; PAM sequence: TTA
ctgtattttattttatattt

SEQ ID NO: 307413 - DNA, 20 bp, Artificial Sequence
  Description of Artificial Sequence: Synthetic oligonucleotide
  Target: ATXN1; (+) strand; PAM type: YTN; PAM sequence: CTG
tattttattttatatttagt

SEQ ID NO: 307414 - DNA, 20 bp, Artificial Sequence
  Description of Artificial Sequence: Synthetic oligonucleotide
  Target: ATXN1; (+) strand; PAM type: YTN; PAM sequence: TTT
tattttatatttagtaaaaa

SEQ ID NO: 307415 - DNA, 20 bp, Artificial Sequence
  Description of Artificial Sequence: Synthetic oligonucleotide
  Target: ATXN1; (+) strand; PAM type: YTN; PAM sequence: TTT
attttatatttagtaaaaac

SEQ ID NO: 307416 - DNA, 20 bp, Artificial Sequence
  Description of Artificial Sequence: Synthetic oligonucleotide
  Target: ATXN1; (+) strand; PAM type: YTN; PAM sequence: TTA
ttttatatttagtaaaaaca

SEQ ID NO: 307417 - DNA, 20 bp, Artificial Sequence
  Description of Artificial Sequence: Synthetic oligonucleotide
  Target: ATXN1; (+) strand; PAM type: YTN; PAM sequence: TTT
tatatttagtaaaaacaatt

SEQ ID NO: 307418 - DNA, 20 bp, Artificial Sequence
  Description of Artificial Sequence: Synthetic oligonucleotide
  Target: ATXN1; (+) strand; PAM type: YTN; PAM sequence: TTT
atatttagtaaaaacaattt

SEQ ID NO: 307419 - DNA, 20 bp, Artificial Sequence
  Description of Artificial Sequence: Synthetic oligonucleotide
  Target: ATXN1; (+) strand; PAM type: YTN; PAM sequence: TTA
tatttagtaaaaacaatttt

SEQ ID NO: 307420 - DNA, 20 bp, Artificial Sequence
  Description of Artificial Sequence: Synthetic oligonucleotide
  Target: ATXN1; (+) strand; PAM type: YTN; PAM sequence: TTT
agtaaaaacaatttttgaac

SEQ ID NO: 307421 - DNA, 20 bp, Artificial Sequence
  Description of Artificial Sequence: Synthetic oligonucleotide
  Target: ATXN1; (+) strand; PAM type: YTN; PAM sequence: TTA
gtaaaaacaatttttgaaca

SEQ ID NO: 307422 - DNA, 20 bp, Artificial Sequence
  Description of Artificial Sequence: Synthetic oligonucleotide
  Target: ATXN1; (+) strand; PAM type: YTN; PAM sequence: TTT
ttgaacataattttgcaagt

SEQ ID NO: 307423 - DNA, 20 bp, Artificial Sequence
  Description of Artificial Sequence: Synthetic oligonucleotide
  Target: ATXN1; (+) strand; PAM type: YTN; PAM sequence: TTT
tgaacataattttgcaagtt

SEQ ID NO: 307424 - DNA, 20 bp, Artificial Sequence
  Description of Artificial Sequence: Synthetic oligonucleotide
  Target: ATXN1; (+) strand; PAM type: YTN; PAM sequence: TTT
gaacataattttgcaagttc

SEQ ID NO: 307425 - DNA, 20 bp, Artificial Sequence
  Description of Artificial Sequence: Synthetic oligonucleotide
  Target: ATXN1; (+) strand; PAM type: YTN; PAM sequence: TTG
aacataattttgcaagttct

SEQ ID NO: 307426 - DNA, 20 bp, Artificial Sequence
  Description of Artificial Sequence: Synthetic oligonucleotide
  Target: ATXN1; (+) strand; PAM type: YTN; PAM sequence: TTT
tgcaagttctacaatgacac

SEQ ID NO: 307427 - DNA, 20 bp, Artificial Sequence
  Description of Artificial Sequence: Synthetic oligonucleotide
  Target: ATXN1; (+) strand; PAM type: YTN; PAM sequence: TTT
gcaagttctacaatgacaca

SEQ ID NO: 307428 - DNA, 20 bp, Artificial Sequence
  Description of Artificial Sequence: Synthetic oligonucleotide
  Target: ATXN1; (+) strand; PAM type: YTN; PAM sequence: TTG
caagttctacaatgacacag

SEQ ID NO: 307429 - DNA, 20 bp, Artificial Sequence
  Description of Artificial Sequence: Synthetic oligonucleotide
  Target: ATXN1; (+) strand; PAM type: YTN; PAM sequence: TTC
tacaatgacacaggtggtag

SEQ ID NO: 307430 - DNA, 20 bp, Artificial Sequence
  Description of Artificial Sequence: Synthetic oligonucleotide
  Target: ATXN1; (+) strand; PAM type: YTN; PAM sequence: CTA
caatgacacaggtggtaggc

SEQ ID NO: 307431 - DNA, 20 bp, Artificial Sequence
  Description of Artificial Sequence: Synthetic oligonucleotide
  Target: ATXN1; (+) strand; PAM type: YTN; PAM sequence: TTA
gttaaaagcacagggtctaa

SEQ ID NO: 307432 - DNA, 20 bp, Artificial Sequence
  Description of Artificial Sequence: Synthetic oligonucleotide
  Target: ATXN1; (+) strand; PAM type: YTN; PAM sequence: TTA
aaagcacagggtctaaggtt

SEQ ID NO: 307433 - DNA, 20 bp, Artificial Sequence
  Description of Artificial Sequence: Synthetic oligonucleotide
  Target: ATXN1; (+) strand; PAM type: YTN; PAM sequence: CTA
aggttaaaatggcatgcatg

SEQ ID NO: 307434 - DNA, 20 bp, Artificial Sequence
  Description of Artificial Sequence: Synthetic oligonucleotide
  Target: ATXN1; (+) strand; PAM type: YTN; PAM sequence: TTA
aaatggcatgcatgaagccc

SEQ ID NO: 307435 - DNA, 20 bp, Artificial Sequence
  Description of Artificial Sequence: Synthetic oligonucleotide
  Target: ATXN1; (+) strand; PAM type: YTN; PAM sequence: CTT
actagctctgtgaccttggg

SEQ ID NO: 307436 - DNA, 20 bp, Artificial Sequence
  Description of Artificial Sequence: Synthetic oligonucleotide
  Target: ATXN1; (+) strand; PAM type: YTN; PAM sequence: TTA
ctagctctgtgaccttgggc

SEQ ID NO: 307437 - DNA, 20 bp, Artificial Sequence
  Description of Artificial Sequence: Synthetic oligonucleotide
  Target: ATXN1; (+) strand; PAM type: YTN; PAM sequence: CTA
gctctgtgaccttgggcaag

SEQ ID NO: 307438 - DNA, 20 bp, Artificial Sequence
  Description of Artificial Sequence: Synthetic oligonucleotide
  Target: ATXN1; (+) strand; PAM type: YTN; PAM sequence: CTC
tgtgaccttgggcaagctac

SEQ ID NO: 307439 - DNA, 20 bp, Artificial Sequence
  Description of Artificial Sequence: Synthetic oligonucleotide
  Target: ATXN1; (+) strand; PAM type: YTN; PAM sequence: CTG
tgaccttgggcaagctacta

SEQ ID NO: 307440 - DNA, 20 bp, Artificial Sequence
  Description of Artificial Sequence: Synthetic oligonucleotide
  Target: ATXN1; (+) strand; PAM type: YTN; PAM sequence: CTT
gggcaagctactaacccggt

SEQ ID NO: 307441 - DNA, 20 bp, Artificial Sequence
  Description of Artificial Sequence: Synthetic oligonucleotide
  Target: ATXN1; (+) strand; PAM type: YTN; PAM sequence: TTG
ggcaagctactaacccggtt

SEQ ID NO: 307442 - DNA, 20 bp, Artificial Sequence
  Description of Artificial Sequence: Synthetic oligonucleotide
  Target: ATXN1; (+) strand; PAM type: YTN; PAM sequence: CTA
ctaacccggttacctcatct

SEQ ID NO: 307443 - DNA, 20 bp, Artificial Sequence
  Description of Artificial Sequence: Synthetic oligonucleotide
  Target: ATXN1; (+) strand; PAM type: YTN; PAM sequence: CTA
acccggttacctcatctgta

SEQ ID NO: 307444 - DNA, 20 bp, Artificial Sequence
  Description of Artificial Sequence: Synthetic oligonucleotide
  Target: ATXN1; (+) strand; PAM type: YTN; PAM sequence: TTA
cctcatctgtaaggtggaga

SEQ ID NO: 307445 - DNA, 20 bp, Artificial Sequence
  Description of Artificial Sequence: Synthetic oligonucleotide
  Target: ATXN1; (+) strand; PAM type: YTN; PAM sequence: CTC
atctgtaaggtggagataat

SEQ ID NO: 307446 - DNA, 20 bp, Artificial Sequence
  Description of Artificial Sequence: Synthetic oligonucleotide
  Target: ATXN1; (+) strand; PAM type: YTN; PAM sequence: CTG
taaggtggagataataatga

SEQ ID NO: 307447 - DNA, 20 bp, Artificial Sequence
  Description of Artificial Sequence: Synthetic oligonucleotide
  Target: ATXN1; (+) strand; PAM type: YTN; PAM sequence: CTA
tgtaggtttactgtgaggat

SEQ ID NO: 307448 - DNA, 20 bp, Artificial Sequence
  Description of Artificial Sequence: Synthetic oligonucleotide
  Target: ATXN1; (+) strand; PAM type: YTN; PAM sequence: TTT
actgtgaggattaagtgatt

SEQ ID NO: 307449 - DNA, 20 bp, Artificial Sequence
  Description of Artificial Sequence: Synthetic oligonucleotide
  Target: ATXN1; (+) strand; PAM type: YTN; PAM sequence: TTA
ctgtgaggattaagtgatta

SEQ ID NO: 307450 - DNA, 20 bp, Artificial Sequence
  Description of Artificial Sequence: Synthetic oligonucleotide
  Target: ATXN1; (+) strand; PAM type: YTN; PAM sequence: CTG
tgaggattaagtgattagta

SEQ ID NO: 307451 - DNA, 20 bp, Artificial Sequence
  Description of Artificial Sequence: Synthetic oligonucleotide
  Target: ATXN1; (+) strand; PAM type: YTN; PAM sequence: TTA
agtgattagtacagtgactg

SEQ ID NO: 307452 - DNA, 20 bp, Artificial Sequence
  Description of Artificial Sequence: Synthetic oligonucleotide
  Target: ATXN1; (+) strand; PAM type: YTN; PAM sequence: TTA
gtacagtgactgacacatcc

SEQ ID NO: 307453 - DNA, 20 bp, Artificial Sequence
  Description of Artificial Sequence: Synthetic oligonucleotide
  Target: ATXN1; (+) strand; PAM type: YTN; PAM sequence: CTG
acacatcctaaatcctcaat

SEQ ID NO: 307454 - DNA, 20 bp, Artificial Sequence
  Description of Artificial Sequence: Synthetic oligonucleotide
  Target: ATXN1; (+) strand; PAM type: YTN; PAM sequence: CTA
aatcctcaatatgccagcca

SEQ ID NO: 307455 - DNA, 20 bp, Artificial Sequence
  Description of Artificial Sequence: Synthetic oligonucleotide
  Target: ATXN1; (+) strand; PAM type: YTN; PAM sequence: CTC
aatatgccagccagccatta

SEQ ID NO: 307456 - DNA, 20 bp, Artificial Sequence
  Description of Artificial Sequence: Synthetic oligonucleotide
  Target: ATXN1; (+) strand; PAM type: YTN; PAM sequence: TTA
ttattgttagaagaacaggc

SEQ ID NO: 307457 - DNA, 20 bp, Artificial Sequence
  Description of Artificial Sequence: Synthetic oligonucleotide
  Target: ATXN1; (+) strand; PAM type: YTN; PAM sequence: TTA
ttgttagaagaacaggctcc

SEQ ID NO: 307458 - DNA, 20 bp, Artificial Sequence
  Description of Artificial Sequence: Synthetic oligonucleotide
  Target: ATXN1; (+) strand; PAM type: YTN; PAM sequence: TTG
ttagaagaacaggctccctg

SEQ ID NO: 307459 - DNA, 20 bp, Artificial Sequence
  Description of Artificial Sequence: Synthetic oligonucleotide
  Target: ATXN1; (+) strand; PAM type: YTN; PAM sequence: TTA
gaagaacaggctccctgcat

SEQ ID NO: 307460 - DNA, 20 bp, Artificial Sequence
  Description of Artificial Sequence: Synthetic oligonucleotide
  Target: ATXN1; (+) strand; PAM type: YTN; PAM sequence: CTC
cctgcattgtgggcttttct

SEQ ID NO: 307461 - DNA, 20 bp, Artificial Sequence
  Description of Artificial Sequence: Synthetic oligonucleotide
  Target: ATXN1; (+) strand; PAM type: YTN; PAM sequence: CTG
cattgtgggcttttctgagt

SEQ ID NO: 307462 - DNA, 20 bp, Artificial Sequence
  Description of Artificial Sequence: Synthetic oligonucleotide
  Target: ATXN1; (+) strand; PAM type: YTN; PAM sequence: TTG
tgggcttttctgagtgtgta

SEQ ID NO: 307463 - DNA, 20 bp, Artificial Sequence
  Description of Artificial Sequence: Synthetic oligonucleotide
  Target: ATXN1; (+) strand; PAM type: YTN; PAM sequence: CTT
ttctgagtgtgtacactccc

SEQ ID NO: 307464 - DNA, 20 bp, Artificial Sequence
  Description of Artificial Sequence: Synthetic oligonucleotide
  Target: ATXN1; (+) strand; PAM type: YTN; PAM sequence: TTT
tctgagtgtgtacactccct

SEQ ID NO: 307465 - DNA, 20 bp, Artificial Sequence
  Description of Artificial Sequence: Synthetic oligonucleotide
  Target: ATXN1; (+) strand; PAM type: YTN; PAM sequence: TTT
ctgagtgtgtacactccctc

SEQ ID NO: 307466 - DNA, 20 bp, Artificial Sequence
  Description of Artificial Sequence: Synthetic oligonucleotide
  Target: ATXN1; (+) strand; PAM type: YTN; PAM sequence: TTC
tgagtgtgtacactccctcc

SEQ ID NO: 307467 - DNA, 20 bp, Artificial Sequence
  Description of Artificial Sequence: Synthetic oligonucleotide
  Target: ATXN1; (+) strand; PAM type: YTN; PAM sequence: CTG
agtgtgtacactccctcctt

SEQ ID NO: 307468 - DNA, 20 bp, Artificial Sequence
  Description of Artificial Sequence: Synthetic oligonucleotide
  Target: ATXN1; (+) strand; PAM type: YTN; PAM sequence: CTC
cctccttgtgtttctgatcg

SEQ ID NO: 307469 - DNA, 20 bp, Artificial Sequence
  Description of Artificial Sequence: Synthetic oligonucleotide
  Target: ATXN1; (+) strand; PAM type: YTN; PAM sequence: CTC
cttgtgtttctgatcgcaaa

SEQ ID NO: 307470 - DNA, 20 bp, Artificial Sequence
  Description of Artificial Sequence: Synthetic oligonucleotide
  Target: ATXN1; (+) strand; PAM type: YTN; PAM sequence: CTT
gtgtttctgatcgcaaataa

SEQ ID NO: 307471 - DNA, 20 bp, Artificial Sequence
  Description of Artificial Sequence: Synthetic oligonucleotide
  Target: ATXN1; (+) strand; PAM type: YTN; PAM sequence: TTG
tgtttctgatcgcaaataaa

SEQ ID NO: 307472 - DNA, 20 bp, Artificial Sequence
  Description of Artificial Sequence: Synthetic oligonucleotide
  Target: ATXN1; (+) strand; PAM type: YTN; PAM sequence: TTT
ctgatcgcaaataaatattt

SEQ ID NO: 307473 - DNA, 20 bp, Artificial Sequence
  Description of Artificial Sequence: Synthetic oligonucleotide
  Target: ATXN1; (+) strand; PAM type: YTN; PAM sequence: TTC
tgatcgcaaataaatattta

SEQ ID NO: 307474 - DNA, 20 bp, Artificial Sequence
  Description of Artificial Sequence: Synthetic oligonucleotide
  Target: ATXN1; (+) strand; PAM type: YTN; PAM sequence: CTG
atcgcaaataaatatttatt

SEQ ID NO: 307475 - DNA, 20 bp, Artificial Sequence
  Description of Artificial Sequence: Synthetic oligonucleotide
  Target: ATXN1; (+) strand; PAM type: YTN; PAM sequence: TTT
attaacaatgatttattgaa

SEQ ID NO: 307476 - DNA, 20 bp, Artificial Sequence
  Description of Artificial Sequence: Synthetic oligonucleotide
  Target: ATXN1; (+) strand; PAM type: YTN; PAM sequence: TTA
ttaacaatgatttattgaat

SEQ ID NO: 307477 - DNA, 20 bp, Artificial Sequence
  Description of Artificial Sequence: Synthetic oligonucleotide
  Target: ATXN1; (+) strand; PAM type: YTN; PAM sequence: TTA
acaatgatttattgaataaa

SEQ ID NO: 307478 - DNA, 20 bp, Artificial Sequence
  Description of Artificial Sequence: Synthetic oligonucleotide
  Target: ATXN1; (+) strand; PAM type: YTN; PAM sequence: TTT
attgaataaaactatcagca

SEQ ID NO: 307479 - DNA, 20 bp, Artificial Sequence
  Description of Artificial Sequence: Synthetic oligonucleotide
  Target: ATXN1; (+) strand; PAM type: YTN; PAM sequence: TTA
ttgaataaaactatcagcaa

SEQ ID NO: 307480 - DNA, 20 bp, Artificial Sequence
  Description of Artificial Sequence: Synthetic oligonucleotide
  Target: ATXN1; (+) strand; PAM type: YTN; PAM sequence: TTG
aataaaactatcagcaatca

SEQ ID NO: 307481 - DNA, 20 bp, Artificial Sequence
  Description of Artificial Sequence: Synthetic oligonucleotide
  Target: ATXN1; (+) strand; PAM type: YTN; PAM sequence: CTA
tcagcaatcaagttccactt

SEQ ID NO: 307482 - DNA, 20 bp, Artificial Sequence
  Description of Artificial Sequence: Synthetic oligonucleotide
  Target: ATXN1; (+) strand; PAM type: YTN; PAM sequence: TTC
cacttttttaagagccactc

SEQ ID NO: 307483 - DNA, 20 bp, Artificial Sequence
  Description of Artificial Sequence: Synthetic oligonucleotide
  Target: ATXN1; (+) strand; PAM type: YTN; PAM sequence: CTT
ttttaagagccactccgtgt

SEQ ID NO: 307484 - DNA, 20 bp, Artificial Sequence
  Description of Artificial Sequence: Synthetic oligonucleotide
  Target: ATXN1; (+) strand; PAM type: YTN; PAM sequence: TTT
tttaagagccactccgtgtg

SEQ ID NO: 307485 - DNA, 20 bp, Artificial Sequence
  Description of Artificial Sequence: Synthetic oligonucleotide
  Target: ATXN1; (+) strand; PAM type: YTN; PAM sequence: TTT
ttaagagccactccgtgtgt

SEQ ID NO: 307486 - DNA, 20 bp, Artificial Sequence
  Description of Artificial Sequence: Synthetic oligonucleotide
  Target: ATXN1; (+) strand; PAM type: YTN; PAM sequence: TTT
taagagccactccgtgtgtc

SEQ ID NO: 307487 - DNA, 20 bp, Artificial Sequence
  Description of Artificial Sequence: Synthetic oligonucleotide
  Target: ATXN1; (+) strand; PAM type: YTN; PAM sequence: TTT
aagagccactccgtgtgtca

SEQ ID NO: 307488 - DNA, 20 bp, Artificial Sequence
  Description of Artificial Sequence: Synthetic oligonucleotide
  Target: ATXN1; (+) strand; PAM type: YTN; PAM sequence: TTA
agagccactccgtgtgtcac

SEQ ID NO: 307489 - DNA, 20 bp, Artificial Sequence
  Description of Artificial Sequence: Synthetic oligonucleotide
  Target: ATXN1; (+) strand; PAM type: YTN; PAM sequence: CTC
cgtgtgtcactagaagatgc

SEQ ID NO: 307490 - DNA, 20 bp, Artificial Sequence
  Description of Artificial Sequence: Synthetic oligonucleotide
  Target: ATXN1; (+) strand; PAM type: YTN; PAM sequence: CTA
gaagatgcccaaatgaatgg

SEQ ID NO: 307491 - DNA, 20 bp, Artificial Sequence
  Description of Artificial Sequence: Synthetic oligonucleotide
  Target: ATXN1; (+) strand; PAM type: YTN; PAM sequence: CTA
atggtttataagaaaagtgt

SEQ ID NO: 307492 - DNA, 20 bp, Artificial Sequence
  Description of Artificial Sequence: Synthetic oligonucleotide
  Target: ATXN1; (+) strand; PAM type: YTN; PAM sequence: TTT
ataagaaaagtgtgaagaat

SEQ ID NO: 307493 - DNA, 20 bp, Artificial Sequence
  Description of Artificial Sequence: Synthetic oligonucleotide
  Target: ATXN1; (+) strand; PAM type: YTN; PAM sequence: TTA
taagaaaagtgtgaagaatc

SEQ ID NO: 307494 - DNA, 20 bp, Artificial Sequence
  Description of Artificial Sequence: Synthetic oligonucleotide
  Target: ATXN1; (+) strand; PAM type: YTN; PAM sequence: CTG
aatatccaggaaccctttca

SEQ ID NO: 307495 - DNA, 20 bp, Artificial Sequence
  Description of Artificial Sequence: Synthetic oligonucleotide
  Target: ATXN1; (+) strand; PAM type: YTN; PAM sequence: CTT
tcagggaagcctcattaata

SEQ ID NO: 307496 - DNA, 20 bp, Artificial Sequence
  Description of Artificial Sequence: Synthetic oligonucleotide
  Target: ATXN1; (+) strand; PAM type: YTN; PAM sequence: TTT
cagggaagcctcattaatat

SEQ ID NO: 307497 - DNA, 20 bp, Artificial Sequence
  Description of Artificial Sequence: Synthetic oligonucleotide
  Target: ATXN1; (+) strand; PAM type: YTN; PAM sequence: TTC
agggaagcctcattaatatt

SEQ ID NO: 307498 - DNA, 20 bp, Artificial Sequence
  Description of Artificial Sequence: Synthetic oligonucleotide
  Target: ATXN1; (+) strand; PAM type: YTN; PAM sequence: CTC
attaatattaactgctatat

SEQ ID NO: 307499 - DNA, 20 bp, Artificial Sequence
  Description of Artificial Sequence: Synthetic oligonucleotide
  Target: ATXN1; (+) strand; PAM type: YTN; PAM sequence: TTA
atattaactgctatatataa

SEQ ID NO: 307500 - DNA, 20 bp, Artificial Sequence
  Description of Artificial Sequence: Synthetic oligonucleotide
  Target: ATXN1; (+) strand; PAM type: YTN; PAM sequence: TTA
actgctatatataagagaag

SEQ ID NO: 307501 - DNA, 20 bp, Artificial Sequence
  Description of Artificial Sequence: Synthetic oligonucleotide
  Target: ATXN1; (+) strand; PAM type: YTN; PAM sequence: CTG
ctatatataagagaagacca

SEQ ID NO: 307502 - DNA, 20 bp, Artificial Sequence
  Description of Artificial Sequence: Synthetic oligonucleotide
  Target: ATXN1; (+) strand; PAM type: YTN; PAM sequence: CTA
tatataagagaagaccaaaa

SEQ ID NO: 307503 - DNA, 20 bp, Artificial Sequence
  Description of Artificial Sequence: Synthetic oligonucleotide
  Target: ATXN1; (+) strand; PAM type: YTN; PAM sequence: TTC
tgtctcggggtacagacaaa

SEQ ID NO: 307504 - DNA, 20 bp, Artificial Sequence
  Description of Artificial Sequence: Synthetic oligonucleotide
  Target: ATXN1; (+) strand; PAM type: YTN; PAM sequence: CTG
tctcggggtacagacaaaat

SEQ ID NO: 307505 - DNA, 20 bp, Artificial Sequence
  Description of Artificial Sequence: Synthetic oligonucleotide
  Target: ATXN1; (+) strand; PAM type: YTN; PAM sequence: CTC
ggggtacagacaaaatccag

SEQ ID NO: 307506 - DNA, 20 bp, Artificial Sequence
  Description of Artificial Sequence: Synthetic oligonucleotide
  Target: ATXN1; (+) strand; PAM type: YTN; PAM sequence: TTT
aaagtatgaagatatctacc

SEQ ID NO: 307507 - DNA, 20 bp, Artificial Sequence
  Description of Artificial Sequence: Synthetic oligonucleotide
  Target: ATXN1; (+) strand; PAM type: YTN; PAM sequence: TTA
aagtatgaagatatctacca

SEQ ID NO: 307508 - DNA, 20 bp, Artificial Sequence
  Description of Artificial Sequence: Synthetic oligonucleotide
  Target: ATXN1; (+) strand; PAM type: YTN; PAM sequence: CTA
ccactcacctgtaggtgtac

SEQ ID NO: 307509 - DNA, 20 bp, Artificial Sequence
  Description of Artificial Sequence: Synthetic oligonucleotide
  Target: ATXN1; (+) strand; PAM type: YTN; PAM sequence: CTC
acctgtaggtgtactcagag

SEQ ID NO: 307510 - DNA, 20 bp, Artificial Sequence
  Description of Artificial Sequence: Synthetic oligonucleotide
  Target: ATXN1; (+) strand; PAM type: YTN; PAM sequence: CTG
taggtgtactcagagttcac

SEQ ID NO: 307511 - DNA, 20 bp, Artificial Sequence
  Description of Artificial Sequence: Synthetic oligonucleotide
  Target: ATXN1; (+) strand; PAM type: YTN; PAM sequence: CTC
agagttcacaaaatacatta

SEQ ID NO: 307512 - DNA, 20 bp, Artificial Sequence
  Description of Artificial Sequence: Synthetic oligonucleotide
  Target: ATXN1; (+) strand; PAM type: YTN; PAM sequence: TTC
acaaaatacattaagtccta

SEQ ID NO: 307513 - DNA, 20 bp, Artificial Sequence
  Description of Artificial Sequence: Synthetic oligonucleotide
  Target: ATXN1; (+) strand; PAM type: YTN; PAM sequence: TTA
agtcctaatatcttacattg

SEQ ID NO: 307514 - DNA, 20 bp, Artificial Sequence
  Description of Artificial Sequence: Synthetic oligonucleotide
  Target: ATXN1; (+) strand; PAM type: YTN; PAM sequence: CTA
atatcttacattgacaaaga

SEQ ID NO: 307515 - DNA, 20 bp, Artificial Sequence
  Description of Artificial Sequence: Synthetic oligonucleotide
  Target: ATXN1; (+) strand; PAM type: YTN; PAM sequence: CTT
acattgacaaagaataatca

SEQ ID NO: 307516 - DNA, 20 bp, Artificial Sequence
  Description of Artificial Sequence: Synthetic oligonucleotide
  Target: ATXN1; (+) strand; PAM type: YTN; PAM sequence: TTA
cattgacaaagaataatcat

SEQ ID NO: 307517 - DNA, 20 bp, Artificial Sequence
  Description of Artificial Sequence: Synthetic oligonucleotide
  Target: ATXN1; (+) strand; PAM type: YTN; PAM sequence: TTG
acaaagaataatcattagga

SEQ ID NO: 307518 - DNA, 20 bp, Artificial Sequence
  Description of Artificial Sequence: Synthetic oligonucleotide
  Target: ATXN1; (+) strand; PAM type: YTN; PAM sequence: TTA
ggaagatccacttaactctt

SEQ ID NO: 307519 - DNA, 20 bp, Artificial Sequence
  Description of Artificial Sequence: Synthetic oligonucleotide
  Target: ATXN1; (+) strand; PAM type: YTN; PAM sequence: CTT
aactctttttaaaaggttgc

SEQ ID NO: 307520 - DNA, 20 bp, Artificial Sequence
  Description of Artificial Sequence: Synthetic oligonucleotide
  Target: ATXN1; (+) strand; PAM type: YTN; PAM sequence: TTA
actctttttaaaaggttgca

SEQ ID NO: 307521 - DNA, 20 bp, Artificial Sequence
  Description of Artificial Sequence: Synthetic oligonucleotide
  Target: ATXN1; (+) strand; PAM type: YTN; PAM sequence: CTC
tttttaaaaggttgcagtga

SEQ ID NO: 307522 - DNA, 20 bp, Artificial Sequence
  Description of Artificial Sequence: Synthetic oligonucleotide
  Target: ATXN1; (+) strand; PAM type: YTN; PAM sequence: CTT
tttaaaaggttgcagtgagc

SEQ ID NO: 307523 - DNA, 20 bp, Artificial Sequence
  Description of Artificial Sequence: Synthetic oligonucleotide
  Target: ATXN1; (+) strand; PAM type: YTN; PAM sequence: TTT
ttaaaaggttgcagtgagct

SEQ ID NO: 307524 - DNA, 20 bp, Artificial Sequence
  Description of Artificial Sequence: Synthetic oligonucleotide
  Target: ATXN1; (+) strand; PAM type: YTN; PAM sequence: TTT
taaaaggttgcagtgagctg

SEQ ID NO: 307525 - DNA, 20 bp, Artificial Sequence
  Description of Artificial Sequence: Synthetic oligonucleotide
  Target: ATXN1; (+) strand; PAM type: YTN; PAM sequence: TTT
aaaaggttgcagtgagctga

SEQ ID NO: 307526 - DNA, 20 bp, Artificial Sequence
  Description of Artificial Sequence: Synthetic oligonucleotide
  Target: ATXN1; (+) strand; PAM type: YTN; PAM sequence: TTA
aaaggttgcagtgagctgag

SEQ ID NO: 307527 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatcgtgcc

SEQ ID NO: 307528 - DNA, 20 bp, Artificial Sequence
  Description of Artificial Sequence: Synthetic oligonucleotide
  Target: ATXN1; (+) strand; PAM type: YTN; PAM sequence: CTG
agatcgtgccattgcactcc

SEQ ID NO: 307529 - DNA, 20 bp, Artificial Sequence
  Description of Artificial Sequence: Synthetic oligonucleotide
  Target: ATXN1; (+) strand; PAM type: YTN; PAM sequence: TTG
cactccagcccaggcaacag

SEQ ID NO: 307530 - DNA, 20 bp, Artificial Sequence
  Description of Artificial Sequence: Synthetic oligonucleotide
  Target: ATXN1; (+) strand; PAM type: YTN; PAM sequence: CTC
cagcccaggcaacagtgcga

SEQ ID NO: 307531 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaaagaaaaaaa

SEQ ID NO: 307532 - DNA, 20 bp, Artificial Sequence
  Description of Artificial Sequence: Synthetic oligonucleotide
  Target: ATXN1; (+) strand; PAM type: YTN; PAM sequence: CTC
aaaaaagaaaaaaaaactgt

SEQ ID NO: 307533 - DNA, 20 bp, Artificial Sequence
  Description of Artificial Sequence: Synthetic oligonucleotide
  Target: ATXN1; (+) strand; PAM type: YTN; PAM sequence: CTG
tccctcaaataatacaaaaa

SEQ ID NO: 307534 - DNA, 20 bp, Artificial Sequence
  Description of Artificial Sequence: Synthetic oligonucleotide
  Target: ATXN1; (+) strand; PAM type: YTN; PAM sequence: CTC
aaataatacaaaaaaagcat

SEQ ID NO: 307535 - DNA, 20 bp, Artificial Sequence
  Description of Artificial Sequence: Synthetic oligonucleotide
  Target: ATXN1; (+) strand; PAM type: YTN; PAM sequence: TTA
atctgtttgaaaccatgggc

SEQ ID NO: 307536 - DNA, 20 bp, Artificial Sequence
  Description of Artificial Sequence: Synthetic oligonucleotide
  Target: ATXN1; (+) strand; PAM type: YTN; PAM sequence: CTG
tttgaaaccatgggccacaa

SEQ ID NO: 307537 - DNA, 20 bp, Artificial Sequence
  Description of Artificial Sequence: Synthetic oligonucleotide
  Target: ATXN1; (+) strand; PAM type: YTN; PAM sequence: TTT
gaaaccatgggccacaactt

SEQ ID NO: 307538 - DNA, 20 bp, Artificial Sequence
  Description of Artificial Sequence: Synthetic oligonucleotide
  Target: ATXN1; (+) strand; PAM type: YTN; PAM sequence: TTG
aaaccatgggccacaactta

SEQ ID NO: 307539 - DNA, 20 bp, Artificial Sequence
  Description of Artificial Sequence: Synthetic oligonucleotide
  Target: ATXN1; (+) strand; PAM type: YTN; PAM sequence: CTT
attccgcattatttttccct

SEQ ID NO: 307540 - DNA, 20 bp, Artificial Sequence
  Description of Artificial Sequence: Synthetic oligonucleotide
  Target: ATXN1; (+) strand; PAM type: YTN; PAM sequence: TTA
ttccgcattatttttccctg

SEQ ID NO: 307541 - DNA, 20 bp, Artificial Sequence
  Description of Artificial Sequence: Synthetic oligonucleotide
  Target: ATXN1; (+) strand; PAM type: YTN; PAM sequence: TTC
cgcattatttttccctgcta

SEQ ID NO: 307542 - DNA, 20 bp, Artificial Sequence
  Description of Artificial Sequence: Synthetic oligonucleotide
  Target: ATXN1; (+) strand; PAM type: YTN; PAM sequence: TTA
tttttccctgctagcatagt

SEQ ID NO: 307543 - DNA, 20 bp, Artificial Sequence
  Description of Artificial Sequence: Synthetic oligonucleotide
  Target: ATXN1; (+) strand; PAM type: YTN; PAM sequence: TTT
ttccctgctagcatagtact

SEQ ID NO: 307544 - DNA, 20 bp, Artificial Sequence
  Description of Artificial Sequence: Synthetic oligonucleotide
  Target: ATXN1; (+) strand; PAM type: YTN; PAM sequence: TTT
tccctgctagcatagtactc

SEQ ID NO: 307545 - DNA, 20 bp, Artificial Sequence
  Description of Artificial Sequence: Synthetic oligonucleotide
  Target: ATXN1; (+) strand; PAM type: YTN; PAM sequence: TTT
ccctgctagcatagtactct

SEQ ID NO: 307546 - DNA, 20 bp, Artificial Sequence
  Description of Artificial Sequence: Synthetic oligonucleotide
  Target: ATXN1; (+) strand; PAM type: YTN; PAM sequence: TTC
cctgctagcatagtactctg

SEQ ID NO: 307547 - DNA, 20 bp, Artificial Sequence
  Description of Artificial Sequence: Synthetic oligonucleotide
  Target: ATXN1; (+) strand; PAM type: YTN; PAM sequence: CTG
ctagcatagtactctgcata

SEQ ID NO: 307548 - DNA, 20 bp, Artificial Sequence
  Description of Artificial Sequence: Synthetic oligonucleotide
  Target: ATXN1; (+) strand; PAM type: YTN; PAM sequence: CTA
gcatagtactctgcatatag

SEQ ID NO: 307549 - DNA, 20 bp, Artificial Sequence
  Description of Artificial Sequence: Synthetic oligonucleotide
  Target: ATXN1; (+) strand; PAM type: YTN; PAM sequence: CTC
tgcatatagtaggctgagaa

SEQ ID NO: 307550 - DNA, 20 bp, Artificial Sequence
  Description of Artificial Sequence: Synthetic oligonucleotide
  Target: ATXN1; (+) strand; PAM type: YTN; PAM sequence: CTG
catatagtaggctgagaaaa

SEQ ID NO: 307551 - DNA, 20 bp, Artificial Sequence
  Description of Artificial Sequence: Synthetic oligonucleotide
  Target: ATXN1; (+) strand; PAM type: YTN; PAM sequence: CTG
agaaaaaatagaattaaatt

SEQ ID NO: 307552 - DNA, 20 bp, Artificial Sequence
  Description of Artificial Sequence: Synthetic oligonucleotide
  Target: ATXN1; (+) strand; PAM type: YTN; PAM sequence: TTA
aattgaatgcaaaatgagat

SEQ ID NO: 307553 - DNA, 20 bp, Artificial Sequence
  Description of Artificial Sequence: Synthetic oligonucleotide
  Target: ATXN1; (+) strand; PAM type: YTN; PAM sequence: TTG
aatgcaaaatgagattagac

SEQ ID NO: 307554 - DNA, 20 bp, Artificial Sequence
  Description of Artificial Sequence: Synthetic oligonucleotide
  Target: ATXN1; (+) strand; PAM type: YTN; PAM sequence: TTA
gacaaaaagatgtttaaaga

SEQ ID NO: 307555 - DNA, 20 bp, Artificial Sequence
  Description of Artificial Sequence: Synthetic oligonucleotide
  Target: ATXN1; (+) strand; PAM type: YTN; PAM sequence: TTT
aaagacccttctgatttaaa

SEQ ID NO: 307556 - DNA, 20 bp, Artificial Sequence
  Description of Artificial Sequence: Synthetic oligonucleotide
  Target: ATXN1; (+) strand; PAM type: YTN; PAM sequence: TTA
aagacccttctgatttaaat

SEQ ID NO: 307557 - DNA, 20 bp, Artificial Sequence
  Description of Artificial Sequence: Synthetic oligonucleotide
  Target: ATXN1; (+) strand; PAM type: YTN; PAM sequence: CTT
ctgatttaaatttcatgaat

SEQ ID NO: 307558 - DNA, 20 bp, Artificial Sequence
  Description of Artificial Sequence: Synthetic oligonucleotide
  Target: ATXN1; (+) strand; PAM type: YTN; PAM sequence: TTC
tgatttaaatttcatgaatt

SEQ ID NO: 307559 - DNA, 20 bp, Artificial Sequence
  Description of Artificial Sequence: Synthetic oligonucleotide
  Target: ATXN1; (+) strand; PAM type: YTN; PAM sequence: CTG
atttaaatttcatgaattac

SEQ ID NO: 307560 - DNA, 20 bp, Artificial Sequence
  Description of Artificial Sequence: Synthetic oligonucleotide
  Target: ATXN1; (+) strand; PAM type: YTN; PAM sequence: TTT
aaatttcatgaattacaaac

SEQ ID NO: 307561 - DNA, 20 bp, Artificial Sequence
  Description of Artificial Sequence: Synthetic oligonucleotide
  Target: ATXN1; (+) strand; PAM type: YTN; PAM sequence: TTA
aatttcatgaattacaaact

SEQ ID NO: 307562 - DNA, 20 bp, Artificial Sequence
  Description of Artificial Sequence: Synthetic oligonucleotide
  Target: ATXN1; (+) strand; PAM type: YTN; PAM sequence: TTT
catgaattacaaactgccta

SEQ ID NO: 307563 - DNA, 20 bp, Artificial Sequence
  Description of Artificial Sequence: Synthetic oligonucleotide
  Target: ATXN1; (+) strand; PAM type: YTN; PAM sequence: TTC
atgaattacaaactgcctaa

SEQ ID NO: 307564 - DNA, 20 bp, Artificial Sequence
  Description of Artificial Sequence: Synthetic oligonucleotide
  Target: ATXN1; (+) strand; PAM type: YTN; PAM sequence: TTA
caaactgcctaaatactcaa

SEQ ID NO: 307565 - DNA, 20 bp, Artificial Sequence
  Description of Artificial Sequence: Synthetic oligonucleotide
  Target: ATXN1; (+) strand; PAM type: YTN; PAM sequence: CTG
cctaaatactcaaactgtta

SEQ ID NO: 307566 - DNA, 20 bp, Artificial Sequence
  Description of Artificial Sequence: Synthetic oligonucleotide
  Target: ATXN1; (+) strand; PAM type: YTN; PAM sequence: CTA
aatactcaaactgttattga

SEQ ID NO: 307567 - DNA, 20 bp, Artificial Sequence
  Description of Artificial Sequence: Synthetic oligonucleotide
  Target: ATXN1; (+) strand; PAM type: YTN; PAM sequence: CTC
aaactgttattgattatagc

SEQ ID NO: 307568 - DNA, 20 bp, Artificial Sequence
  Description of Artificial Sequence: Synthetic oligonucleotide
  Target: ATXN1; (+) strand; PAM type: YTN; PAM sequence: CTG
ttattgattatagctgatat

SEQ ID NO: 307569 - DNA, 20 bp, Artificial Sequence
  Description of Artificial Sequence: Synthetic oligonucleotide
  Target: ATXN1; (+) strand; PAM type: YTN; PAM sequence: TTA
ttgattatagctgatattca

SEQ ID NO: 307570 - DNA, 20 bp, Artificial Sequence
  Description of Artificial Sequence: Synthetic oligonucleotide
  Target: ATXN1; (+) strand; PAM type: YTN; PAM sequence: TTG
attatagctgatattcatgg

SEQ ID NO: 307571 - DNA, 20 bp, Artificial Sequence
  Description of Artificial Sequence: Synthetic oligonucleotide
  Target: ATXN1; (+) strand; PAM type: YTN; PAM sequence: TTA
tagctgatattcatggctaa

SEQ ID NO: 307572 - DNA, 20 bp, Artificial Sequence
  Description of Artificial Sequence: Synthetic oligonucleotide
  Target: ATXN1; (+) strand; PAM type: YTN; PAM sequence: CTG
atattcatggctaaactcca

SEQ ID NO: 307573 - DNA, 20 bp, Artificial Sequence
  Description of Artificial Sequence: Synthetic oligonucleotide
  Target: ATXN1; (+) strand; PAM type: YTN; PAM sequence: TTC
atggctaaactccagaattc

SEQ ID NO: 307574 - DNA, 20 bp, Artificial Sequence
  Description of Artificial Sequence: Synthetic oligonucleotide
  Target: ATXN1; (+) strand; PAM type: YTN; PAM sequence: CTA
aactccagaattcactgata

SEQ ID NO: 307575 - DNA, 20 bp, Artificial Sequence
  Description of Artificial Sequence: Synthetic oligonucleotide
  Target: ATXN1; (+) strand; PAM type: YTN; PAM sequence: CTC
cagaattcactgatacatta

SEQ ID NO: 307576 - DNA, 20 bp, Artificial Sequence
  Description of Artificial Sequence: Synthetic oligonucleotide
  Target: ATXN1; (+) strand; PAM type: YTN; PAM sequence: TTC
actgatacattaataatgaa

SEQ ID NO: 307577 - DNA, 20 bp, Artificial Sequence
  Description of Artificial Sequence: Synthetic oligonucleotide
  Target: ATXN1; (+) strand; PAM type: YTN; PAM sequence: CTG
atacattaataatgaaatgt

SEQ ID NO: 307578 - DNA, 20 bp, Artificial Sequence
  Description of Artificial Sequence: Synthetic oligonucleotide
  Target: ATXN1; (+) strand; PAM type: YTN; PAM sequence: TTA
ataatgaaatgtattcctct

SEQ ID NO: 307579 - DNA, 20 bp, Artificial Sequence
  Description of Artificial Sequence: Synthetic oligonucleotide
  Target: ATXN1; (+) strand; PAM type: YTN; PAM sequence: TTC
ctctctccttaatttcactt

SEQ ID NO: 307580 - DNA, 20 bp, Artificial Sequence
  Description of Artificial Sequence: Synthetic oligonucleotide
  Target: ATXN1; (+) strand; PAM type: YTN; PAM sequence: CTC
tctccttaatttcacttaat

SEQ ID NO: 307581 - DNA, 20 bp, Artificial Sequence
  Description of Artificial Sequence: Synthetic oligonucleotide
  Target: ATXN1; (+) strand; PAM type: YTN; PAM sequence: CTC
tccttaatttcacttaatgt

SEQ ID NO: 307582 - DNA, 20 bp, Artificial Sequence
  Description of Artificial Sequence: Synthetic oligonucleotide
  Target: ATXN1; (+) strand; PAM type: YTN; PAM sequence: CTC
cttaatttcacttaatgtga

SEQ ID NO: 307583 - DNA, 20 bp, Artificial Sequence
  Description of Artificial Sequence: Synthetic oligonucleotide
  Target: ATXN1; (+) strand; PAM type: YTN; PAM sequence: CTT
aatttcacttaatgtgagca

SEQ ID NO: 307584 - DNA, 20 bp, Artificial Sequence
  Description of Artificial Sequence: Synthetic oligonucleotide
  Target: ATXN1; (+) strand; PAM type: YTN; PAM sequence: TTA
atttcacttaatgtgagcat

SEQ ID NO: 307585 - DNA, 20 bp, Artificial Sequence
  Description of Artificial Sequence: Synthetic oligonucleotide
  Target: ATXN1; (+) strand; PAM type: YTN; PAM sequence: TTT
cacttaatgtgagcatgttc

SEQ ID NO: 307586 - DNA, 20 bp, Artificial Sequence
  Description of Artificial Sequence: Synthetic oligonucleotide
  Target: ATXN1; (+) strand; PAM type: YTN; PAM sequence: TTC
acttaatgtgagcatgttca

SEQ ID NO: 307587 - DNA, 20 bp, Artificial Sequence
  Description of Artificial Sequence: Synthetic oligonucleotide
  Target: ATXN1; (+) strand; PAM type: YTN; PAM sequence: CTT
aatgtgagcatgttcaatct

SEQ ID NO: 307588 - DNA, 20 bp, Artificial Sequence
  Description of Artificial Sequence: Synthetic oligonucleotide
  Target: ATXN1; (+) strand; PAM type: YTN; PAM sequence: TTA
atgtgagcatgttcaatcta

SEQ ID NO: 307589 - DNA, 20 bp, Artificial Sequence
  Description of Artificial Sequence: Synthetic oligonucleotide
  Target: ATXN1; (+) strand; PAM type: YTN; PAM sequence: TTC
aatctacagctttgatttca

SEQ ID NO: 307590 - DNA, 20 bp, Artificial Sequence
  Description of Artificial Sequence: Synthetic oligonucleotide
  Target: ATXN1; (+) strand; PAM type: YTN; PAM sequence: CTA
cagctttgatttcagtgttt

SEQ ID NO: 307591 - DNA, 20 bp, Artificial Sequence
  Description of Artificial Sequence: Synthetic oligonucleotide
  Target: ATXN1; (+) strand; PAM type: YTN; PAM sequence: CTT
tgatttcagtgtttaatttt

SEQ ID NO: 307592 - DNA, 20 bp, Artificial Sequence
  Description of Artificial Sequence: Synthetic oligonucleotide
  Target: ATXN1; (+) strand; PAM type: YTN; PAM sequence: TTT
gatttcagtgtttaatttta

SEQ ID NO: 307593 - DNA, 20 bp, Artificial Sequence
  Description of Artificial Sequence: Synthetic oligonucleotide
  Target: ATXN1; (+) strand; PAM type: YTN; PAM sequence: TTG
atttcagtgtttaattttat

SEQ ID NO: 307594 - DNA, 20 bp, Artificial Sequence
  Description of Artificial Sequence: Synthetic oligonucleotide
  Target: ATXN1; (+) strand; PAM type: YTN; PAM sequence: TTT
cagtgtttaattttattatc

SEQ ID NO: 307595 - DNA, 20 bp, Artificial Sequence
  Description of Artificial Sequence: Synthetic oligonucleotide
  Target: ATXN1; (+) strand; PAM type: YTN; PAM sequence: TTC
agtgtttaattttattatca

SEQ ID NO: 307596 - DNA, 20 bp, Artificial Sequence
  Description of Artificial Sequence: Synthetic oligonucleotide
  Target: ATXN1; (+) strand; PAM type: YTN; PAM sequence: TTT
aattttattatcaaagtatt

SEQ ID NO: 307597 - DNA, 20 bp, Artificial Sequence
  Description of Artificial Sequence: Synthetic oligonucleotide
  Target: ATXN1; (+) strand; PAM type: YTN; PAM sequence: TTA
attttattatcaaagtatta

SEQ ID NO: 307598 - DNA, 20 bp, Artificial Sequence
  Description of Artificial Sequence: Synthetic oligonucleotide
  Target: ATXN1; (+) strand; PAM type: YTN; PAM sequence: TTT
tattatcaaagtattaagaa

SEQ ID NO: 307599 - DNA, 20 bp, Artificial Sequence
  Description of Artificial Sequence: Synthetic oligonucleotide
  Target: ATXN1; (+) strand; PAM type: YTN; PAM sequence: TTT
attatcaaagtattaagaat

SEQ ID NO: 307600 - DNA, 20 bp, Artificial Sequence
  Description of Artificial Sequence: Synthetic oligonucleotide
  Target: ATXN1; (+) strand; PAM type: YTN; PAM sequence: TTA
ttatcaaagtattaagaata

SEQ ID NO: 307601 - DNA, 20 bp, Artificial Sequence
  Description of Artificial Sequence: Synthetic oligonucleotide
  Target: ATXN1; (+) strand; PAM type: YTN; PAM sequence: TTA
tcaaagtattaagaatatgc

SEQ ID NO: 307602 - DNA, 20 bp, Artificial Sequence
  Description of Artificial Sequence: Synthetic oligonucleotide
  Target: ATXN1; (+) strand; PAM type: YTN; PAM sequence: TTA
agaatatgcctacctggtaa

SEQ ID NO: 307603 - DNA, 20 bp, Artificial Sequence
  Description of Artificial Sequence: Synthetic oligonucleotide
  Target: ATXN1; (+) strand; PAM type: YTN; PAM sequence: CTA
cctggtaagtttttagaaac

SEQ ID NO: 307604 - DNA, 20 bp, Artificial Sequence
  Description of Artificial Sequence: Synthetic oligonucleotide
  Target: ATXN1; (+) strand; PAM type: YTN; PAM sequence: CTG
gtaagtttttagaaacataa

SEQ ID NO: 307605 - DNA, 20 bp, Artificial Sequence
  Description of Artificial Sequence: Synthetic oligonucleotide
  Target: ATXN1; (+) strand; PAM type: YTN; PAM sequence: TTT
ttagaaacataaaggaactg

SEQ ID NO: 307606 - DNA, 20 bp, Artificial Sequence
  Description of Artificial Sequence: Synthetic oligonucleotide
  Target: ATXN1; (+) strand; PAM type: YTN; PAM sequence: TTT
tagaaacataaaggaactga

SEQ ID NO: 307607 - DNA, 20 bp, Artificial Sequence
  Description of Artificial Sequence: Synthetic oligonucleotide
  Target: ATXN1; (+) strand; PAM type: YTN; PAM sequence: TTT
agaaacataaaggaactgac

SEQ ID NO: 307608 - DNA, 20 bp, Artificial Sequence
  Description of Artificial Sequence: Synthetic oligonucleotide
  Target: ATXN1; (+) strand; PAM type: YTN; PAM sequence: TTA
gaaacataaaggaactgaca

SEQ ID NO: 307609 - DNA, 20 bp, Artificial Sequence
  Description of Artificial Sequence: Synthetic oligonucleotide
  Target: ATXN1; (+) strand; PAM type: YTN; PAM sequence: CTG
acaactttgggaaatatata

SEQ ID NO: 307610 - DNA, 20 bp, Artificial Sequence
  Description of Artificial Sequence: Synthetic oligonucleotide
  Target: ATXN1; (+) strand; PAM type: YTN; PAM sequence: CTT
tgggaaatatatacgttctg

SEQ ID NO: 307611 - DNA, 20 bp, Artificial Sequence
  Description of Artificial Sequence: Synthetic oligonucleotide
  Target: ATXN1; (+) strand; PAM type: YTN; PAM sequence: TTT
gggaaatatatacgttctga

SEQ ID NO: 307612 - DNA, 20 bp, Artificial Sequence
  Description of Artificial Sequence: Synthetic oligonucleotide
  Target: ATXN1; (+) strand; PAM type: YTN; PAM sequence: TTG
ggaaatatatacgttctgaa

SEQ ID NO: 307613 - DNA, 20 bp, Artificial Sequence
  Description of Artificial Sequence: Synthetic oligonucleotide
  Target: ATXN1; (+) strand; PAM type: YTN; PAM sequence: TTC
tgaaagaacgaaattaaggc

SEQ ID NO: 307614 - DNA, 20 bp, Artificial Sequence
  Description of Artificial Sequence: Synthetic oligonucleotide
  Target: ATXN1; (+) strand; PAM type: YTN; PAM sequence: CTG
aaagaacgaaattaaggcat

SEQ ID NO: 307615 - DNA, 20 bp, Artificial Sequence
  Description of Artificial Sequence: Synthetic oligonucleotide
  Target: ATXN1; (+) strand; PAM type: YTN; PAM sequence: TTA
aggcatttgctttgtgttct

SEQ ID NO: 307616 - DNA, 20 bp, Artificial Sequence
  Description of Artificial Sequence: Synthetic oligonucleotide
  Target: ATXN1; (+) strand; PAM type: YTN; PAM sequence: TTT
gctttgtgttctttctttaa

SEQ ID NO: 307617 - DNA, 20 bp, Artificial Sequence
  Description of Artificial Sequence: Synthetic oligonucleotide
  Target: ATXN1; (+) strand; PAM type: YTN; PAM sequence: TTG
ctttgtgttctttctttaac

SEQ ID NO: 307618 - DNA, 20 bp, Artificial Sequence
  Description of Artificial Sequence: Synthetic oligonucleotide
  Target: ATXN1; (+) strand; PAM type: YTN; PAM sequence: CTT
tgtgttctttctttaacagt

SEQ ID NO: 307619 - DNA, 20 bp, Artificial Sequence
  Description of Artificial Sequence: Synthetic oligonucleotide
  Target: ATXN1; (+) strand; PAM type: YTN; PAM sequence: TTT
gtgttctttctttaacagtt

SEQ ID NO: 307620 - DNA, 20 bp, Artificial Sequence
  Description of Artificial Sequence: Synthetic oligonucleotide
  Target: ATXN1; (+) strand; PAM type: YTN; PAM sequence: TTG
tgttctttctttaacagttc

SEQ ID NO: 307621 - DNA, 20 bp, Artificial Sequence
  Description of Artificial Sequence: Synthetic oligonucleotide
  Target: ATXN1; (+) strand; PAM type: YTN; PAM sequence: TTC
tttctttaacagttcctaat

SEQ ID NO: 307622 - DNA, 20 bp, Artificial Sequence
  Description of Artificial Sequence: Synthetic oligonucleotide
  Target: ATXN1; (+) strand; PAM type: YTN; PAM sequence: CTT
tctttaacagttcctaatct

SEQ ID NO: 307623 - DNA, 20 bp, Artificial Sequence
  Description of Artificial Sequence: Synthetic oligonucleotide
  Target: ATXN1; (+) strand; PAM type: YTN; PAM sequence: TTT
ctttaacagttcctaatctc

SEQ ID NO: 307624 - DNA, 20 bp, Artificial Sequence
  Description of Artificial Sequence: Synthetic oligonucleotide
  Target: ATXN1; (+) strand; PAM type: YTN; PAM sequence: TTC
tttaacagttcctaatctcc

SEQ ID NO: 307625 - DNA, 20 bp, Artificial Sequence
  Description of Artificial Sequence: Synthetic oligonucleotide
  Target: ATXN1; (+) strand; PAM type: YTN; PAM sequence: CTT
taacagttcctaatctccct

SEQ ID NO: 307626 - DNA, 20 bp, Artificial Sequence
  Description of Artificial Sequence: Synthetic oligonucleotide
  Target: ATXN1; (+) strand; PAM type: YTN; PAM sequence: TTT
aacagttcctaatctccctt

SEQ ID NO: 307627 - DNA, 20 bp, Artificial Sequence
  Description of Artificial Sequence: Synthetic oligonucleotide
  Target: ATXN1; (+) strand; PAM type: YTN; PAM sequence: TTA
acagttcctaatctcccttc

SEQ ID NO: 307628 - DNA, 20 bp, Artificial Sequence
  Description of Artificial Sequence: Synthetic oligonucleotide
  Target: ATXN1; (+) strand; PAM type: YTN; PAM sequence: TTC
ctaatctcccttcagtgtat

SEQ ID NO: 307629 - DNA, 20 bp, Artificial Sequence
  Description of Artificial Sequence: Synthetic oligonucleotide
  Target: ATXN1; (+) strand; PAM type: YTN; PAM sequence: CTA
atctcccttcagtgtattta

SEQ ID NO: 307630 - DNA, 20 bp, Artificial Sequence
  Description of Artificial Sequence: Synthetic oligonucleotide
  Target: ATXN1; (+) strand; PAM type: YTN; PAM sequence: CTC
ccttcagtgtatttattggg

SEQ ID NO: 307631 - DNA, 20 bp, Artificial Sequence
  Description of Artificial Sequence: Synthetic oligonucleotide
  Target: ATXN1; (+) strand; PAM type: YTN; PAM sequence: CTT
cagtgtatttattgggcatt

SEQ ID NO: 307632 - DNA, 20 bp, Artificial Sequence
  Description of Artificial Sequence: Synthetic oligonucleotide
  Target: ATXN1; (+) strand; PAM type: YTN; PAM sequence: TTC
agtgtatttattgggcatta

SEQ ID NO: 307633 - DNA, 20 bp, Artificial Sequence
  Description of Artificial Sequence: Synthetic oligonucleotide
  Target: ATXN1; (+) strand; PAM type: YTN; PAM sequence: TTT
attgggcattagttgttatc

SEQ ID NO: 307634 - DNA, 20 bp, Artificial Sequence
  Description of Artificial Sequence: Synthetic oligonucleotide
  Target: ATXN1; (+) strand; PAM type: YTN; PAM sequence: TTA
ttgggcattagttgttatct

SEQ ID NO: 307635 - DNA, 20 bp, Artificial Sequence
  Description of Artificial Sequence: Synthetic oligonucleotide
  Target: ATXN1; (+) strand; PAM type: YTN; PAM sequence: TTG
ggcattagttgttatctaac

SEQ ID NO: 307636 - DNA, 20 bp, Artificial Sequence
  Description of Artificial Sequence: Synthetic oligonucleotide
  Target: ATXN1; (+) strand; PAM type: YTN; PAM sequence: TTA
gttgttatctaacacaacag

SEQ ID NO: 307637 - DNA, 20 bp, Artificial Sequence
  Description of Artificial Sequence: Synthetic oligonucleotide
  Target: ATXN1; (+) strand; PAM type: YTN; PAM sequence: TTG
ttatctaacacaacagttct

SEQ ID NO: 307638 - DNA, 20 bp, Artificial Sequence
  Description of Artificial Sequence: Synthetic oligonucleotide
  Target: ATXN1; (+) strand; PAM type: YTN; PAM sequence: TTA
tctaacacaacagttctcct

SEQ ID NO: 307639 - DNA, 20 bp, Artificial Sequence
  Description of Artificial Sequence: Synthetic oligonucleotide
  Target: ATXN1; (+) strand; PAM type: YTN; PAM sequence: CTA
acacaacagttctcctagta

SEQ ID NO: 307640 - DNA, 20 bp, Artificial Sequence
  Description of Artificial Sequence: Synthetic oligonucleotide
  Target: ATXN1; (+) strand; PAM type: YTN; PAM sequence: TTC
tcctagtagaatgaaatcaa

SEQ ID NO: 307641 - DNA, 20 bp, Artificial Sequence
  Description of Artificial Sequence: Synthetic oligonucleotide
  Target: ATXN1; (+) strand; PAM type: YTN; PAM sequence: CTC
ctagtagaatgaaatcaacc

SEQ ID NO: 307642 - DNA, 20 bp, Artificial Sequence
  Description of Artificial Sequence: Synthetic oligonucleotide
  Target: ATXN1; (+) strand; PAM type: YTN; PAM sequence: CTA
gtagaatgaaatcaacctta

SEQ ID NO: 307643 - DNA, 20 bp, Artificial Sequence
  Description of Artificial Sequence: Synthetic oligonucleotide
  Target: ATXN1; (+) strand; PAM type: YTN; PAM sequence: CTT
aaaataaagagcttttcagg

SEQ ID NO: 307644 - DNA, 20 bp, Artificial Sequence
  Description of Artificial Sequence: Synthetic oligonucleotide
  Target: ATXN1; (+) strand; PAM type: YTN; PAM sequence: TTA
aaataaagagcttttcagga

SEQ ID NO: 307645 - DNA, 20 bp, Artificial Sequence
  Description of Artificial Sequence: Synthetic oligonucleotide
  Target: ATXN1; (+) strand; PAM type: YTN; PAM sequence: CTT
ttcaggagtaaaaagaggct

SEQ ID NO: 307646 - DNA, 20 bp, Artificial Sequence
  Description of Artificial Sequence: Synthetic oligonucleotide
  Target: ATXN1; (+) strand; PAM type: YTN; PAM sequence: TTT
tcaggagtaaaaagaggctg

SEQ ID NO: 307647 - DNA, 20 bp, Artificial Sequence
  Description of Artificial Sequence: Synthetic oligonucleotide
  Target: ATXN1; (+) strand; PAM type: YTN; PAM sequence: TTT
caggagtaaaaagaggctgt

SEQ ID NO: 307648 - DNA, 20 bp, Artificial Sequence
  Description of Artificial Sequence: Synthetic oligonucleotide
  Target: ATXN1; (+) strand; PAM type: YTN; PAM sequence: TTC
aggagtaaaaagaggctgtt

SEQ ID NO: 307649 - DNA, 20 bp, Artificial Sequence
  Description of Artificial Sequence: Synthetic oligonucleotide
  Target: ATXN1; (+) strand; PAM type: YTN; PAM sequence: CTG
ttacaaaagaaaaatgctag

SEQ ID NO: 307650 - DNA, 20 bp, Artificial Sequence
  Description of Artificial Sequence: Synthetic oligonucleotide
  Target: ATXN1; (+) strand; PAM type: YTN; PAM sequence: TTA
caaaagaaaaatgctagagg

SEQ ID NO: 307651 - DNA, 20 bp, Artificial Sequence
  Description of Artificial Sequence: Synthetic oligonucleotide
  Target: ATXN1; (+) strand; PAM type: YTN; PAM sequence: CTA
gaggggaattatctttatat

SEQ ID NO: 307652 - DNA, 20 bp, Artificial Sequence
  Description of Artificial Sequence: Synthetic oligonucleotide
  Target: ATXN1; (+) strand; PAM type: YTN; PAM sequence: TTA
tctttatatcacatagtaat

SEQ ID NO: 307653 - DNA, 20 bp, Artificial Sequence
  Description of Artificial Sequence: Synthetic oligonucleotide
  Target: ATXN1; (+) strand; PAM type: YTN; PAM sequence: CTT
tatatcacatagtaatttac

SEQ ID NO: 307654 - DNA, 20 bp, Artificial Sequence
  Description of Artificial Sequence: Synthetic oligonucleotide
  Target: ATXN1; (+) strand; PAM type: YTN; PAM sequence: TTT
atatcacatagtaatttaca

SEQ ID NO: 307655 - DNA, 20 bp, Artificial Sequence
  Description of Artificial Sequence: Synthetic oligonucleotide
  Target: ATXN1; (+) strand; PAM type: YTN; PAM sequence: TTA
tatcacatagtaatttacat

SEQ ID NO: 307656 - DNA, 20 bp, Artificial Sequence
  Description of Artificial Sequence: Synthetic oligonucleotide
  Target: ATXN1; (+) strand; PAM type: YTN; PAM sequence: TTT
acatcttagaaacttaaagt

SEQ ID NO: 307657 - DNA, 20 bp, Artificial Sequence
  Description of Artificial Sequence: Synthetic oligonucleotide
  Target: ATXN1; (+) strand; PAM type: YTN; PAM sequence: TTA
catcttagaaacttaaagtt

SEQ ID NO: 307658 - DNA, 20 bp, Artificial Sequence
  Description of Artificial Sequence: Synthetic oligonucleotide
  Target: ATXN1; (+) strand; PAM type: YTN; PAM sequence: CTT
agaaacttaaagttgtatca

SEQ ID NO: 307659 - DNA, 20 bp, Artificial Sequence
  Description of Artificial Sequence: Synthetic oligonucleotide
  Target: ATXN1; (+) strand; PAM type: YTN; PAM sequence: TTA
gaaacttaaagttgtatcat

SEQ ID NO: 307660 - DNA, 20 bp, Artificial Sequence
  Description of Artificial Sequence: Synthetic oligonucleotide
  Target: ATXN1; (+) strand; PAM type: YTN; PAM sequence: CTT
aaagttgtatcatagctgta

SEQ ID NO: 307661 - DNA, 20 bp, Artificial Sequence
  Description of Artificial Sequence: Synthetic oligonucleotide
  Target: ATXN1; (+) strand; PAM type: YTN; PAM sequence: TTA
aagttgtatcatagctgtac

SEQ ID NO: 307662 - DNA, 20 bp, Artificial Sequence
  Description of Artificial Sequence: Synthetic oligonucleotide
  Target: ATXN1; (+) strand; PAM type: YTN; PAM sequence: TTG
tatcatagctgtacaattag

SEQ ID NO: 307663 - DNA, 20 bp, Artificial Sequence
  Description of Artificial Sequence: Synthetic oligonucleotide
  Target: ATXN1; (+) strand; PAM type: YTN; PAM sequence: CTG
tacaattagccaaaactgaa

SEQ ID NO: 307664 - DNA, 20 bp, Artificial Sequence
  Description of Artificial Sequence: Synthetic oligonucleotide
  Target: ATXN1; (+) strand; PAM type: YTN; PAM sequence: TTA
gccaaaactgaatatatttt

SEQ ID NO: 307665 - DNA, 20 bp, Artificial Sequence
  Description of Artificial Sequence: Synthetic oligonucleotide
  Target: ATXN1; (+) strand; PAM type: YTN; PAM sequence: CTG
aatatattttatgagatact

SEQ ID NO: 307666 - DNA, 20 bp, Artificial Sequence
  Description of Artificial Sequence: Synthetic oligonucleotide
  Target: ATXN1; (+) strand; PAM type: YTN; PAM sequence: TTT
tatgagatactgattactca

SEQ ID NO: 307667 - DNA, 20 bp, Artificial Sequence
  Description of Artificial Sequence: Synthetic oligonucleotide
  Target: ATXN1; (+) strand; PAM type: YTN; PAM sequence: TTT
atgagatactgattactcac

SEQ ID NO: 307668 - DNA, 20 bp, Artificial Sequence
  Description of Artificial Sequence: Synthetic oligonucleotide
  Target: ATXN1; (+) strand; PAM type: YTN; PAM sequence: TTA
tgagatactgattactcaca

SEQ ID NO: 307669 - DNA, 20 bp, Artificial Sequence
  Description of Artificial Sequence: Synthetic oligonucleotide
  Target: ATXN1; (+) strand; PAM type: YTN; PAM sequence: CTG
attactcacaagaacaaagg

SEQ ID NO: 307670 - DNA, 20 bp, Artificial Sequence
  Description of Artificial Sequence: Synthetic oligonucleotide
  Target: ATXN1; (+) strand; PAM type: YTN; PAM sequence: TTA
ctcacaagaacaaagggaaa

SEQ ID NO: 307671 - DNA, 20 bp, Artificial Sequence
  Description of Artificial Sequence: Synthetic oligonucleotide
  Target: ATXN1; (+) strand; PAM type: YTN; PAM sequence: CTC
acaagaacaaagggaaatcc

SEQ ID NO: 307672 - DNA, 20 bp, Artificial Sequence
  Description of Artificial Sequence: Synthetic oligonucleotide
  Target: ATXN1; (+) strand; PAM type: YTN; PAM sequence: TTG
aaggattaaattcctgtcaa

SEQ ID NO: 307673 - DNA, 20 bp, Artificial Sequence
  Description of Artificial Sequence: Synthetic oligonucleotide
  Target: ATXN1; (+) strand; PAM type: YTN; PAM sequence: TTA
aattcctgtcaaaaccagtc

SEQ ID NO: 307674 - DNA, 20 bp, Artificial Sequence
  Description of Artificial Sequence: Synthetic oligonucleotide
  Target: ATXN1; (+) strand; PAM type: YTN; PAM sequence: TTC
ctgtcaaaaccagtcactca

SEQ ID NO: 307675 - DNA, 20 bp, Artificial Sequence
  Description of Artificial Sequence: Synthetic oligonucleotide
  Target: ATXN1; (+) strand; PAM type: YTN; PAM sequence: CTG
tcaaaaccagtcactcatgt

SEQ ID NO: 307676 - DNA, 20 bp, Artificial Sequence
  Description of Artificial Sequence: Synthetic oligonucleotide
  Target: ATXN1; (+) strand; PAM type: YTN; PAM sequence: CTC
atgtgtctgcacgtatatcg

SEQ ID NO: 307677 - DNA, 20 bp, Artificial Sequence
  Description of Artificial Sequence: Synthetic oligonucleotide
  Target: ATXN1; (+) strand; PAM type: YTN; PAM sequence: CTG
cacgtatatcgcaaagtgtt

SEQ ID NO: 307678 - DNA, 20 bp, Artificial Sequence
  Description of Artificial Sequence: Synthetic oligonucleotide
  Target: ATXN1; (+) strand; PAM type: YTN; PAM sequence: TTT
gtgaatttgatgcatattcc

SEQ ID NO: 307679 - DNA, 20 bp, Artificial Sequence
  Description of Artificial Sequence: Synthetic oligonucleotide
  Target: ATXN1; (+) strand; PAM type: YTN; PAM sequence: TTG
tgaatttgatgcatattcca

SEQ ID NO: 307680 - DNA, 20 bp, Artificial Sequence
  Description of Artificial Sequence: Synthetic oligonucleotide
  Target: ATXN1; (+) strand; PAM type: YTN; PAM sequence: TTT
gatgcatattccaggtataa

SEQ ID NO: 307681 - DNA, 20 bp, Artificial Sequence
  Description of Artificial Sequence: Synthetic oligonucleotide
  Target: ATXN1; (+) strand; PAM type: YTN; PAM sequence: TTG
atgcatattccaggtataaa

SEQ ID NO: 307682 - DNA, 20 bp, Artificial Sequence
  Description of Artificial Sequence: Synthetic oligonucleotide
  Target: ATXN1; (+) strand; PAM type: YTN; PAM sequence: TTC
caggtataaatcccctttcc

SEQ ID NO: 307683 - DNA, 20 bp, Artificial Sequence
  Description of Artificial Sequence: Synthetic oligonucleotide
  Target: ATXN1; (+) strand; PAM type: YTN; PAM sequence: CTT
tccagagagcagaaattcct

SEQ ID NO: 307684 - DNA, 20 bp, Artificial Sequence
  Description of Artificial Sequence: Synthetic oligonucleotide
  Target: ATXN1; (+) strand; PAM type: YTN; PAM sequence: TTT
ccagagagcagaaattccta

SEQ ID NO: 307685 - DNA, 20 bp, Artificial Sequence
  Description of Artificial Sequence: Synthetic oligonucleotide
  Target: ATXN1; (+) strand; PAM type: YTN; PAM sequence: TTC
cagagagcagaaattcctaa

SEQ ID NO: 307686 - DNA, 20 bp, Artificial Sequence
  Description of Artificial Sequence: Synthetic oligonucleotide
  Target: ATXN1; (+) strand; PAM type: YTN; PAM sequence: TTC
ctaatctgccacacttcaaa

SEQ ID NO: 307687 - DNA, 20 bp, Artificial Sequence
  Description of Artificial Sequence: Synthetic oligonucleotide
  Target: ATXN1; (+) strand; PAM type: YTN; PAM sequence: CTA
atctgccacacttcaaactg

SEQ ID NO: 307688 - DNA, 20 bp, Artificial Sequence
  Description of Artificial Sequence: Synthetic oligonucleotide
  Target: ATXN1; (+) strand; PAM type: YTN; PAM sequence: CTG
ccacacttcaaactgaaata

SEQ ID NO: 307689 - DNA, 20 bp, Artificial Sequence
  Description of Artificial Sequence: Synthetic oligonucleotide
  Target: ATXN1; (+) strand; PAM type: YTN; PAM sequence: CTT
caaactgaaatagattcatc

SEQ ID NO: 307690 - DNA, 20 bp, Artificial Sequence
  Description of Artificial Sequence: Synthetic oligonucleotide
  Target: ATXN1; (+) strand; PAM type: YTN; PAM sequence: TTC
aaactgaaatagattcatca

SEQ ID NO: 307691 - DNA, 20 bp, Artificial Sequence
  Description of Artificial Sequence: Synthetic oligonucleotide
  Target: ATXN1; (+) strand; PAM type: YTN; PAM sequence: CTG
aaatagattcatcagcattt

SEQ ID NO: 307692 - DNA, 20 bp, Artificial Sequence
  Description of Artificial Sequence: Synthetic oligonucleotide
  Target: ATXN1; (+) strand; PAM type: YTN; PAM sequence: TTC
atcagcatttcgggtacata

SEQ ID NO: 307693 - DNA, 20 bp, Artificial Sequence
  Description of Artificial Sequence: Synthetic oligonucleotide
  Target: ATXN1; (+) strand; PAM type: YTN; PAM sequence: TTT
cgggtacatacgaacagctc

SEQ ID NO: 307694 - DNA, 20 bp, Artificial Sequence
  Description of Artificial Sequence: Synthetic oligonucleotide
  Target: ATXN1; (+) strand; PAM type: YTN; PAM sequence: TTC
gggtacatacgaacagctcc

SEQ ID NO: 307695 - DNA, 20 bp, Artificial Sequence
  Description of Artificial Sequence: Synthetic oligonucleotide
  Target: ATXN1; (+) strand; PAM type: YTN; PAM sequence: CTC
cccaaagccattagcaaagg

SEQ ID NO: 307696 - DNA, 20 bp, Artificial Sequence
  Description of Artificial Sequence: Synthetic oligonucleotide
  Target: ATXN1; (+) strand; PAM type: YTN; PAM sequence: TTA
gcaaaggttatttgtaagtg

SEQ ID NO: 307697 - DNA, 20 bp, Artificial Sequence
  Description of Artificial Sequence: Synthetic oligonucleotide
  Target: ATXN1; (+) strand; PAM type: YTN; PAM sequence: TTA
tttgtaagtggaaaatcaag

SEQ ID NO: 307698 - DNA, 20 bp, Artificial Sequence
  Description of Artificial Sequence: Synthetic oligonucleotide
  Target: ATXN1; (+) strand; PAM type: YTN; PAM sequence: TTT
gtaagtggaaaatcaagaga

SEQ ID NO: 307699 - DNA, 20 bp, Artificial Sequence
  Description of Artificial Sequence: Synthetic oligonucleotide
  Target: ATXN1; (+) strand; PAM type: YTN; PAM sequence: TTG
taagtggaaaatcaagagac

SEQ ID NO: 307700 - DNA, 20 bp, Artificial Sequence
  Description of Artificial Sequence: Synthetic oligonucleotide
  Target: ATXN1; (+) strand; PAM type: YTN; PAM sequence: TTT
caaagtcaaaatgcaatgtt

SEQ ID NO: 307701 - DNA, 20 bp, Artificial Sequence
  Description of Artificial Sequence: Synthetic oligonucleotide
  Target: ATXN1; (+) strand; PAM type: YTN; PAM sequence: TTC
aaagtcaaaatgcaatgtta

SEQ ID NO: 307702 - DNA, 20 bp, Artificial Sequence
  Description of Artificial Sequence: Synthetic oligonucleotide
  Target: ATXN1; (+) strand; PAM type: YTN; PAM sequence: TTA
tttagttttctgcagcacat

SEQ ID NO: 307703 - DNA, 20 bp, Artificial Sequence
  Description of Artificial Sequence: Synthetic oligonucleotide
  Target: ATXN1; (+) strand; PAM type: YTN; PAM sequence: TTT
agttttctgcagcacataac

SEQ ID NO: 307704 - DNA, 20 bp, Artificial Sequence
  Description of Artificial Sequence: Synthetic oligonucleotide
  Target: ATXN1; (+) strand; PAM type: YTN; PAM sequence: TTA
gttttctgcagcacataaca

SEQ ID NO: 307705 - DNA, 20 bp, Artificial Sequence
  Description of Artificial Sequence: Synthetic oligonucleotide
  Target: ATXN1; (+) strand; PAM type: YTN; PAM sequence: TTT
tctgcagcacataacaaggc

SEQ ID NO: 307706 - DNA, 20 bp, Artificial Sequence
  Description of Artificial Sequence: Synthetic oligonucleotide
  Target: ATXN1; (+) strand; PAM type: YTN; PAM sequence: TTT
ctgcagcacataacaaggca

SEQ ID NO: 307707 - DNA, 20 bp, Artificial Sequence
  Description of Artificial Sequence: Synthetic oligonucleotide
  Target: ATXN1; (+) strand; PAM type: YTN; PAM sequence: TTC
tgcagcacataacaaggcaa

SEQ ID NO: 307708 - DNA, 20 bp, Artificial Sequence
  Description of Artificial Sequence: Synthetic oligonucleotide
  Target: ATXN1; (+) strand; PAM type: YTN; PAM sequence: CTG
cagcacataacaaggcaaaa

SEQ ID NO: 307709 - DNA, 20 bp, Artificial Sequence
  Description of Artificial Sequence: Synthetic oligonucleotide
  Target: ATXN1; (+) strand; PAM type: YTN; PAM sequence: CTT
tcagtcagagagaaaagcaa

SEQ ID NO: 307710 - DNA, 20 bp, Artificial Sequence
  Description of Artificial Sequence: Synthetic oligonucleotide
  Target: ATXN1; (+) strand; PAM type: YTN; PAM sequence: TTT
cagtcagagagaaaagcaaa

SEQ ID NO: 307711 - DNA, 20 bp, Artificial Sequence
  Description of Artificial Sequence: Synthetic oligonucleotide
  Target: ATXN1; (+) strand; PAM type: YTN; PAM sequence: TTC
agtcagagagaaaagcaaaa

SEQ ID NO: 307712 - DNA, 20 bp, Artificial Sequence
  Description of Artificial Sequence: Synthetic oligonucleotide
  Target: ATXN1; (+) strand; PAM type: YTN; PAM sequence: TTG
ctccttcacagagactggta

SEQ ID NO: 307713 - DNA, 20 bp, Artificial Sequence
  Description of Artificial Sequence: Synthetic oligonucleotide
  Target: ATXN1; (+) strand; PAM type: YTN; PAM sequence: CTC
cttcacagagactggtaaat

SEQ ID NO: 307714 - DNA, 20 bp, Artificial Sequence
  Description of Artificial Sequence: Synthetic oligonucleotide
  Target: ATXN1; (+) strand; PAM type: YTN; PAM sequence: CTT
cacagagactggtaaataaa

SEQ ID NO: 307715 - DNA, 20 bp, Artificial Sequence
  Description of Artificial Sequence: Synthetic oligonucleotide
  Target: ATXN1; (+) strand; PAM type: YTN; PAM sequence: TTC
acagagactggtaaataaag

SEQ ID NO: 307716 - DNA, 20 bp, Artificial Sequence
  Description of Artificial Sequence: Synthetic oligonucleotide
  Target: ATXN1; (+) strand; PAM type: YTN; PAM sequence: CTG
gtaaataaagaatgtatgca

SEQ ID NO: 307717 - DNA, 20 bp, Artificial Sequence
  Description of Artificial Sequence: Synthetic oligonucleotide
  Target: ATXN1; (+) strand; PAM type: YTN; PAM sequence: CTG
gatttgctttcctgtttcct

SEQ ID NO: 307718 - DNA, 20 bp, Artificial Sequence
  Description of Artificial Sequence: Synthetic oligonucleotide
  Target: ATXN1; (+) strand; PAM type: YTN; PAM sequence: TTT
gctttcctgtttccttgcca

SEQ ID NO: 307719 - DNA, 20 bp, Artificial Sequence
  Description of Artificial Sequence: Synthetic oligonucleotide
  Target: ATXN1; (+) strand; PAM type: YTN; PAM sequence: TTG
ctttcctgtttccttgccag

SEQ ID NO: 307720 - DNA, 20 bp, Artificial Sequence
  Description of Artificial Sequence: Synthetic oligonucleotide
  Target: ATXN1; (+) strand; PAM type: YTN; PAM sequence: CTT
tcctgtttccttgccagtaa

SEQ ID NO: 307721 - DNA, 20 bp, Artificial Sequence
  Description of Artificial Sequence: Synthetic oligonucleotide
  Target: ATXN1; (+) strand; PAM type: YTN; PAM sequence: TTT
cctgtttccttgccagtaac

SEQ ID NO: 307722 - DNA, 20 bp, Artificial Sequence
  Description of Artificial Sequence: Synthetic oligonucleotide
  Target: ATXN1; (+) strand; PAM type: YTN; PAM sequence: TTC
ctgtttccttgccagtaact

SEQ ID NO: 307723 - DNA, 20 bp, Artificial Sequence
  Description of Artificial Sequence: Synthetic oligonucleotide
  Target: ATXN1; (+) strand; PAM type: YTN; PAM sequence: CTG
tttccttgccagtaactttt

SEQ ID NO: 307724 - DNA, 20 bp, Artificial Sequence
  Description of Artificial Sequence: Synthetic oligonucleotide
  Target: ATXN1; (+) strand; PAM type: YTN; PAM sequence: TTT
ccttgccagtaacttttttt

SEQ ID NO: 307725 - DNA, 20 bp, Artificial Sequence
  Description of Artificial Sequence: Synthetic oligonucleotide
  Target: ATXN1; (+) strand; PAM type: YTN; PAM sequence: TTC
cttgccagtaacttttttta

SEQ ID NO: 307726 - DNA, 20 bp, Artificial Sequence
  Description of Artificial Sequence: Synthetic oligonucleotide
  Target: ATXN1; (+) strand; PAM type: YTN; PAM sequence: CTT
gccagtaactttttttatat

SEQ ID NO: 307727 - DNA, 20 bp, Artificial Sequence
  Description of Artificial Sequence: Synthetic oligonucleotide
  Target: ATXN1; (+) strand; PAM type: YTN; PAM sequence: TTG
ccagtaactttttttatatg

SEQ ID NO: 307728 - DNA, 20 bp, Artificial Sequence
  Description of Artificial Sequence: Synthetic oligonucleotide
  Target: ATXN1; (+) strand; PAM type: YTN; PAM sequence: CTT
tttttatatgattatctaac

SEQ ID NO: 307729 - DNA, 20 bp, Artificial Sequence
  Description of Artificial Sequence: Synthetic oligonucleotide
  Target: ATXN1; (+) strand; PAM type: YTN; PAM sequence: TTT
ttttatatgattatctaaca

SEQ ID NO: 307730 - DNA, 20 bp, Artificial Sequence
  Description of Artificial Sequence: Synthetic oligonucleotide
  Target: ATXN1; (+) strand; PAM type: YTN; PAM sequence: TTT
tttatatgattatctaacag

SEQ ID NO: 307731 - DNA, 20 bp, Artificial Sequence
  Description of Artificial Sequence: Synthetic oligonucleotide
  Target: ATXN1; (+) strand; PAM type: YTN; PAM sequence: TTT
ttatatgattatctaacagt

SEQ ID NO: 307732 - DNA, 20 bp, Artificial Sequence
  Description of Artificial Sequence: Synthetic oligonucleotide
  Target: ATXN1; (+) strand; PAM type: YTN; PAM sequence: TTT
tatatgattatctaacagtc

SEQ ID NO: 307733 - DNA, 20 bp, Artificial Sequence
  Description of Artificial Sequence: Synthetic oligonucleotide
  Target: ATXN1; (+) strand; PAM type: YTN; PAM sequence: TTT
atatgattatctaacagtca

SEQ ID NO: 307734 - DNA, 20 bp, Artificial Sequence
  Description of Artificial Sequence: Synthetic oligonucleotide
  Target: ATXN1; (+) strand; PAM type: YTN; PAM sequence: TTA
tatgattatctaacagtcaa

SEQ ID NO: 307735 - DNA, 20 bp, Artificial Sequence
  Description of Artificial Sequence: Synthetic oligonucleotide
  Target: ATXN1; (+) strand; PAM type: YTN; PAM sequence: TTA
tctaacagtcaaacaaacct

SEQ ID NO: 307736 - DNA, 20 bp, Artificial Sequence
  Description of Artificial Sequence: Synthetic oligonucleotide
  Target: ATXN1; (+) strand; PAM type: YTN; PAM sequence: CTA
acagtcaaacaaaccttcaa

SEQ ID NO: 307737 - DNA, 20 bp, Artificial Sequence
  Description of Artificial Sequence: Synthetic oligonucleotide
  Target: ATXN1; (+) strand; PAM type: YTN; PAM sequence: CTT
caaagcaatgaattacgcat

SEQ ID NO: 307738 - DNA, 20 bp, Artificial Sequence
  Description of Artificial Sequence: Synthetic oligonucleotide
  Target: ATXN1; (+) strand; PAM type: YTN; PAM sequence: TTC
aaagcaatgaattacgcata

SEQ ID NO: 307739 - DNA, 20 bp, Artificial Sequence
  Description of Artificial Sequence: Synthetic oligonucleotide
  Target: ATXN1; (+) strand; PAM type: YTN; PAM sequence: TTA
cgcatagacacacagacaca

SEQ ID NO: 307740 - DNA, 20 bp, Artificial Sequence
  Description of Artificial Sequence: Synthetic oligonucleotide
  Target: ATXN1; (+) strand; PAM type: YTN; PAM sequence: CTC
tcacacaaaagagagcaaag

SEQ ID NO: 307741 - DNA, 20 bp, Artificial Sequence
  Description of Artificial Sequence: Synthetic oligonucleotide
  Target: ATXN1; (+) strand; PAM type: YTN; PAM sequence: CTC
acacaaaagagagcaaagct

SEQ ID NO: 307742 - DNA, 20 bp, Artificial Sequence
  Description of Artificial Sequence: Synthetic oligonucleotide
  Target: ATXN1; (+) strand; PAM type: YTN; PAM sequence: CTG
atgctatttaaatatcgtga

SEQ ID NO: 307743 - DNA, 20 bp, Artificial Sequence
  Description of Artificial Sequence: Synthetic oligonucleotide
  Target: ATXN1; (+) strand; PAM type: YTN; PAM sequence: CTA
tttaaatatcgtgaaatatt

SEQ ID NO: 307744 - DNA, 20 bp, Artificial Sequence
  Description of Artificial Sequence: Synthetic oligonucleotide
  Target: ATXN1; (+) strand; PAM type: YTN; PAM sequence: TTT
aaatatcgtgaaatattttc

SEQ ID NO: 307745 - DNA, 20 bp, Artificial Sequence
  Description of Artificial Sequence: Synthetic oligonucleotide
  Target: ATXN1; (+) strand; PAM type: YTN; PAM sequence: TTA
aatatcgtgaaatattttcc

SEQ ID NO: 307746 - DNA, 20 bp, Artificial Sequence
  Description of Artificial Sequence: Synthetic oligonucleotide
  Target: ATXN1; (+) strand; PAM type: YTN; PAM sequence: TTT
tcctaaccatgcacagatgg

SEQ ID NO: 307747 - DNA, 20 bp, Artificial Sequence
  Description of Artificial Sequence: Synthetic oligonucleotide
  Target: ATXN1; (+) strand; PAM type: YTN; PAM sequence: TTT
cctaaccatgcacagatgga

SEQ ID NO: 307748 - DNA, 20 bp, Artificial Sequence
  Description of Artificial Sequence: Synthetic oligonucleotide
  Target: ATXN1; (+) strand; PAM type: YTN; PAM sequence: TTC
ctaaccatgcacagatggaa

SEQ ID NO: 307749 - DNA, 20 bp, Artificial Sequence
  Description of Artificial Sequence: Synthetic oligonucleotide
  Target: ATXN1; (+) strand; PAM type: YTN; PAM sequence: CTA
accatgcacagatggaagta

SEQ ID NO: 307750 - DNA, 20 bp, Artificial Sequence
  Description of Artificial Sequence: Synthetic oligonucleotide
  Target: ATXN1; (+) strand; PAM type: YTN; PAM sequence: TTT
ctgccaaccgcctggttcag

SEQ ID NO: 307751 - DNA, 20 bp, Artificial Sequence
  Description of Artificial Sequence: Synthetic oligonucleotide
  Target: ATXN1; (+) strand; PAM type: YTN; PAM sequence: TTC
tgccaaccgcctggttcaga

SEQ ID NO: 307752 - DNA, 20 bp, Artificial Sequence
  Description of Artificial Sequence: Synthetic oligonucleotide
  Target: ATXN1; (+) strand; PAM type: YTN; PAM sequence: CTG
ccaaccgcctggttcagaaa

SEQ ID NO: 307753 - DNA, 20 bp, Artificial Sequence
  Description of Artificial Sequence: Synthetic oligonucleotide
  Target: ATXN1; (+) strand; PAM type: YTN; PAM sequence: CTG
gttcagaaactttgctctat

SEQ ID NO: 307754 - DNA, 20 bp, Artificial Sequence
  Description of Artificial Sequence: Synthetic oligonucleotide
  Target: ATXN1; (+) strand; PAM type: YTN; PAM sequence: TTC
agaaactttgctctattttt

SEQ ID NO: 307755 - DNA, 20 bp, Artificial Sequence
  Description of Artificial Sequence: Synthetic oligonucleotide
  Target: ATXN1; (+) strand; PAM type: YTN; PAM sequence: CTT
tgctctatttttaattattt

SEQ ID NO: 307756 - DNA, 20 bp, Artificial Sequence
  Description of Artificial Sequence: Synthetic oligonucleotide
  Target: ATXN1; (+) strand; PAM type: YTN; PAM sequence: TTT
gctctatttttaattatttg

SEQ ID NO: 307757 - DNA, 20 bp, Artificial Sequence
  Description of Artificial Sequence: Synthetic oligonucleotide
  Target: ATXN1; (+) strand; PAM type: YTN; PAM sequence: TTG
ctctatttttaattatttgg

SEQ ID NO: 307758 - DNA, 20 bp, Artificial Sequence
  Description of Artificial Sequence: Synthetic oligonucleotide
  Target: ATXN1; (+) strand; PAM type: YTN; PAM sequence: CTC
tatttttaattatttggttc

SEQ ID NO: 307759 - DNA, 20 bp, Artificial Sequence
  Description of Artificial Sequence: Synthetic oligonucleotide
  Target: ATXN1; (+) strand; PAM type: YTN; PAM sequence: CTA
tttttaattatttggttcag

SEQ ID NO: 307760 - DNA, 20 bp, Artificial Sequence
  Description of Artificial Sequence: Synthetic oligonucleotide
  Target: ATXN1; (+) strand; PAM type: YTN; PAM sequence: TTT
ttaattatttggttcagagg

SEQ ID NO: 307761 - DNA, 20 bp, Artificial Sequence
  Description of Artificial Sequence: Synthetic oligonucleotide
  Target: ATXN1; (+) strand; PAM type: YTN; PAM sequence: TTT
taattatttggttcagagga

SEQ ID NO: 307762 - DNA, 20 bp, Artificial Sequence
  Description of Artificial Sequence: Synthetic oligonucleotide
  Target: ATXN1; (+) strand; PAM type: YTN; PAM sequence: TTT
aattatttggttcagaggac

SEQ ID NO: 307763 - DNA, 20 bp, Artificial Sequence
  Description of Artificial Sequence: Synthetic oligonucleotide
  Target: ATXN1; (+) strand; PAM type: YTN; PAM sequence: TTA
attatttggttcagaggacc

SEQ ID NO: 307764 - DNA, 20 bp, Artificial Sequence
  Description of Artificial Sequence: Synthetic oligonucleotide
  Target: ATXN1; (+) strand; PAM type: YTN; PAM sequence: TTA
tttggttcagaggacccatt

SEQ ID NO: 307765 - DNA, 20 bp, Artificial Sequence
  Description of Artificial Sequence: Synthetic oligonucleotide
  Target: ATXN1; (+) strand; PAM type: YTN; PAM sequence: TTT
ggttcagaggacccatttgt

SEQ ID NO: 307766 - DNA, 20 bp, Artificial Sequence
  Description of Artificial Sequence: Synthetic oligonucleotide
  Target: ATXN1; (+) strand; PAM type: YTN; PAM sequence: TTG
gttcagaggacccatttgtg

SEQ ID NO: 307767 - DNA, 20 bp, Artificial Sequence
  Description of Artificial Sequence: Synthetic oligonucleotide
  Target: ATXN1; (+) strand; PAM type: YTN; PAM sequence: TTC
agaggacccatttgtgatta

SEQ ID NO: 307768 - DNA, 20 bp, Artificial Sequence
  Description of Artificial Sequence: Synthetic oligonucleotide
  Target: ATXN1; (+) strand; PAM type: YTN; PAM sequence: TTT
gtgattaacttctgtgttgc

SEQ ID NO: 307769 - DNA, 20 bp, Artificial Sequence
  Description of Artificial Sequence: Synthetic oligonucleotide
  Target: ATXN1; (+) strand; PAM type: YTN; PAM sequence: TTG
tgattaacttctgtgttgca

SEQ ID NO: 307770 - DNA, 20 bp, Artificial Sequence
  Description of Artificial Sequence: Synthetic oligonucleotide
  Target: ATXN1; (+) strand; PAM type: YTN; PAM sequence: TTA
acttctgtgttgcatggcaa

SEQ ID NO: 307771 - DNA, 20 bp, Artificial Sequence
  Description of Artificial Sequence: Synthetic oligonucleotide
  Target: ATXN1; (+) strand; PAM type: YTN; PAM sequence: CTT
ctgtgttgcatggcaaagga

SEQ ID NO: 307772 - DNA, 20 bp, Artificial Sequence
  Description of Artificial Sequence: Synthetic oligonucleotide
  Target: ATXN1; (+) strand; PAM type: YTN; PAM sequence: TTC
tgtgttgcatggcaaaggaa

SEQ ID NO: 307773 - DNA, 20 bp, Artificial Sequence
  Description of Artificial Sequence: Synthetic oligonucleotide
  Target: ATXN1; (+) strand; PAM type: YTN; PAM sequence: CTG
tgttgcatggcaaaggaagt

SEQ ID NO: 307774 - DNA, 20 bp, Artificial Sequence
  Description of Artificial Sequence: Synthetic oligonucleotide
  Target: ATXN1; (+) strand; PAM type: YTN; PAM sequence: TTG
catggcaaaggaagtaaagt

SEQ ID NO: 307775 - DNA, 20 bp, Artificial Sequence
  Description of Artificial Sequence: Synthetic oligonucleotide
  Target: ATXN1; (+) strand; PAM type: YTN; PAM sequence: TTC
ctgacccacagcaaagaaca

SEQ ID NO: 307776 - DNA, 20 bp, Artificial Sequence
  Description of Artificial Sequence: Synthetic oligonucleotide
  Target: ATXN1; (+) strand; PAM type: YTN; PAM sequence: CTG
acccacagcaaagaacacag

SEQ ID NO: 307777 - DNA, 20 bp, Artificial Sequence
  Description of Artificial Sequence: Synthetic oligonucleotide
  Target: ATXN1; (+) strand; PAM type: YTN; PAM sequence: CTT
aattatttttaaacagctag

SEQ ID NO: 307778 - DNA, 20 bp, Artificial Sequence
  Description of Artificial Sequence: Synthetic oligonucleotide
  Target: ATXN1; (+) strand; PAM type: YTN; PAM sequence: TTA
attatttttaaacagctagt

SEQ ID NO: 307779 - DNA, 20 bp, Artificial Sequence
  Description of Artificial Sequence: Synthetic oligonucleotide
  Target: ATXN1; (+) strand; PAM type: YTN; PAM sequence: TTA
tttttaaacagctagtgtaa

SEQ ID NO: 307780 - DNA, 20 bp, Artificial Sequence
  Description of Artificial Sequence: Synthetic oligonucleotide
  Target: ATXN1; (+) strand; PAM type: YTN; PAM sequence: TTT
ttaaacagctagtgtaatat

SEQ ID NO: 307781 - DNA, 20 bp, Artificial Sequence
  Description of Artificial Sequence: Synthetic oligonucleotide
  Target: ATXN1; (+) strand; PAM type: YTN; PAM sequence: TTT
taaacagctagtgtaatatt

SEQ ID NO: 307782 - DNA, 20 bp, Artificial Sequence
  Description of Artificial Sequence: Synthetic oligonucleotide
  Target: ATXN1; (+) strand; PAM type: YTN; PAM sequence: TTT
aaacagctagtgtaatattg

SEQ ID NO: 307783 - DNA, 20 bp, Artificial Sequence
  Description of Artificial Sequence: Synthetic oligonucleotide
  Target: ATXN1; (+) strand; PAM type: YTN; PAM sequence: TTA
aacagctagtgtaatattgt

SEQ ID NO: 307784 - DNA, 20 bp, Artificial Sequence
  Description of Artificial Sequence: Synthetic oligonucleotide
  Target: ATXN1; (+) strand; PAM type: YTN; PAM sequence: CTA
gtgtaatattgtaaaccatg

SEQ ID NO: 307785 - DNA, 20 bp, Artificial Sequence
  Description of Artificial Sequence: Synthetic oligonucleotide
  Target: ATXN1; (+) strand; PAM type: YTN; PAM sequence: TTG
taaaccatgtgtagagacaa

SEQ ID NO: 307786 - DNA, 20 bp, Artificial Sequence
  Description of Artificial Sequence: Synthetic oligonucleotide
  Target: ATXN1; (+) strand; PAM type: YTN; PAM sequence: CTA
atttgtcaaagaccagttga

SEQ ID NO: 307787 - DNA, 20 bp, Artificial Sequence
  Description of Artificial Sequence: Synthetic oligonucleotide
  Target: ATXN1; (+) strand; PAM type: YTN; PAM sequence: TTT
gtcaaagaccagttgatgac

SEQ ID NO: 307788 - DNA, 20 bp, Artificial Sequence
  Description of Artificial Sequence: Synthetic oligonucleotide
  Target: ATXN1; (+) strand; PAM type: YTN; PAM sequence: TTG
tcaaagaccagttgatgact

SEQ ID NO: 307789 - DNA, 20 bp, Artificial Sequence
  Description of Artificial Sequence: Synthetic oligonucleotide
  Target: ATXN1; (+) strand; PAM type: YTN; PAM sequence: TTG
atgactgttgcagtttgaag

SEQ ID NO: 307790 - DNA, 20 bp, Artificial Sequence
  Description of Artificial Sequence: Synthetic oligonucleotide
  Target: ATXN1; (+) strand; PAM type: YTN; PAM sequence: CTG
ttgcagtttgaagctgtagg

SEQ ID NO: 307791 - DNA, 20 bp, Artificial Sequence
  Description of Artificial Sequence: Synthetic oligonucleotide
  Target: ATXN1; (+) strand; PAM type: YTN; PAM sequence: TTG
cagtttgaagctgtagggtg

SEQ ID NO: 307792 - DNA, 20 bp, Artificial Sequence
  Description of Artificial Sequence: Synthetic oligonucleotide
  Target: ATXN1; (+) strand; PAM type: YTN; PAM sequence: TTT
gaagctgtagggtgtatgaa

SEQ ID NO: 307793 - DNA, 20 bp, Artificial Sequence
  Description of Artificial Sequence: Synthetic oligonucleotide
  Target: ATXN1; (+) strand; PAM type: YTN; PAM sequence: TTG
aagctgtagggtgtatgaag

SEQ ID NO: 307794 - DNA, 20 bp, Artificial Sequence
  Description of Artificial Sequence: Synthetic oligonucleotide
  Target: ATXN1; (+) strand; PAM type: YTN; PAM sequence: CTG
tagggtgtatgaagaacaga

SEQ ID NO: 307795 - DNA, 20 bp, Artificial Sequence
  Description of Artificial Sequence: Synthetic oligonucleotide
  Target: ATXN1; (+) strand; PAM type: YTN; PAM sequence: CTT
tagtaagtgatgccaaaatg

SEQ ID NO: 307796 - DNA, 20 bp, Artificial Sequence
  Description of Artificial Sequence: Synthetic oligonucleotide
  Target: ATXN1; (+) strand; PAM type: YTN; PAM sequence: TTT
agtaagtgatgccaaaatga

SEQ ID NO: 307797 - DNA, 20 bp, Artificial Sequence
  Description of Artificial Sequence: Synthetic oligonucleotide
  Target: ATXN1; (+) strand; PAM type: YTN; PAM sequence: TTA
gtaagtgatgccaaaatgaa

SEQ ID NO: 307798 - DNA, 20 bp, Artificial Sequence
  Description of Artificial Sequence: Synthetic oligonucleotide
  Target: ATXN1; (+) strand; PAM type: YTN; PAM sequence: CTC
ataatgacaaatagattttc

SEQ ID NO: 307799 - DNA, 20 bp, Artificial Sequence
  Description of Artificial Sequence: Synthetic oligonucleotide
  Target: ATXN1; (+) strand; PAM type: YTN; PAM sequence: TTT
tcatctctgagaaataacaa

SEQ ID NO: 307800 - DNA, 20 bp, Artificial Sequence
  Description of Artificial Sequence: Synthetic oligonucleotide
  Target: ATXN1; (+) strand; PAM type: YTN; PAM sequence: TTT
catctctgagaaataacaat

SEQ ID NO: 307801 - DNA, 20 bp, Artificial Sequence
  Description of Artificial Sequence: Synthetic oligonucleotide
  Target: ATXN1; (+) strand; PAM type: YTN; PAM sequence: TTC
atctctgagaaataacaatg

SEQ ID NO: 307802 - DNA, 20 bp, Artificial Sequence
  Description of Artificial Sequence: Synthetic oligonucleotide
  Target: ATXN1; (+) strand; PAM type: YTN; PAM sequence: CTC
tgagaaataacaatggagca

SEQ ID NO: 307803 - DNA, 20 bp, Artificial Sequence
  Description of Artificial Sequence: Synthetic oligonucleotide
  Target: ATXN1; (+) strand; PAM type: YTN; PAM sequence: CTG
agaaataacaatggagcaag

SEQ ID NO: 307804 - DNA, 20 bp, Artificial Sequence
  Description of Artificial Sequence: Synthetic oligonucleotide
  Target: ATXN1; (+) strand; PAM type: YTN; PAM sequence: TTA
atagtgttgtaaggcctaat

SEQ ID NO: 307805 - DNA, 20 bp, Artificial Sequence
  Description of Artificial Sequence: Synthetic oligonucleotide
  Target: ATXN1; (+) strand; PAM type: YTN; PAM sequence: TTG
taaggcctaatctcattagc

SEQ ID NO: 307806 - DNA, 20 bp, Artificial Sequence
  Description of Artificial Sequence: Synthetic oligonucleotide
  Target: ATXN1; (+) strand; PAM type: YTN; PAM sequence: CTA
atctcattagcaggagaagt

SEQ ID NO: 307807 - DNA, 20 bp, Artificial Sequence
  Description of Artificial Sequence: Synthetic oligonucleotide
  Target: ATXN1; (+) strand; PAM type: YTN; PAM sequence: CTC
attagcaggagaagtttcag

SEQ ID NO: 307808 - DNA, 20 bp, Artificial Sequence
  Description of Artificial Sequence: Synthetic oligonucleotide
  Target: ATXN1; (+) strand; PAM type: YTN; PAM sequence: TTA
gcaggagaagtttcagtttt

SEQ ID NO: 307809 - DNA, 20 bp, Artificial Sequence
  Description of Artificial Sequence: Synthetic oligonucleotide
  Target: ATXN1; (+) strand; PAM type: YTN; PAM sequence: TTT
cagttttgactaggagcagt

SEQ ID NO: 307810 - DNA, 20 bp, Artificial Sequence
  Description of Artificial Sequence: Synthetic oligonucleotide
  Target: ATXN1; (+) strand; PAM type: YTN; PAM sequence: TTC
agttttgactaggagcagtg

SEQ ID NO: 307811 - DNA, 20 bp, Artificial Sequence
  Description of Artificial Sequence: Synthetic oligonucleotide
  Target: ATXN1; (+) strand; PAM type: YTN; PAM sequence: TTT
tgactaggagcagtgaatgg

SEQ ID NO: 307812 - DNA, 20 bp, Artificial Sequence
  Description of Artificial Sequence: Synthetic oligonucleotide
  Target: ATXN1; (+) strand; PAM type: YTN; PAM sequence: TTT
gactaggagcagtgaatgga

SEQ ID NO: 307813 - DNA, 20 bp, Artificial Sequence
  Description of Artificial Sequence: Synthetic oligonucleotide
  Target: ATXN1; (+) strand; PAM type: YTN; PAM sequence: TTG
actaggagcagtgaatggaa

SEQ ID NO: 307814 - DNA, 20 bp, Artificial Sequence
  Description of Artificial Sequence: Synthetic oligonucleotide
  Target: ATXN1; (+) strand; PAM type: YTN; PAM sequence: CTA
ggagcagtgaatggaatgcc

SEQ ID NO: 307815 - DNA, 20 bp, Artificial Sequence
  Description of Artificial Sequence: Synthetic oligonucleotide
  Target: ATXN1; (+) strand; PAM type: YTN; PAM sequence: CTT
aagcacaggaaatggactca

SEQ ID NO: 307816 - DNA, 20 bp, Artificial Sequence
  Description of Artificial Sequence: Synthetic oligonucleotide
  Target: ATXN1; (+) strand; PAM type: YTN; PAM sequence: TTA
agcacaggaaatggactcag

SEQ ID NO: 307817 - DNA, 20 bp, Artificial Sequence
  Description of Artificial Sequence: Synthetic oligonucleotide
  Target: ATXN1; (+) strand; PAM type: YTN; PAM sequence: CTC
agatgcaagaagttggtcag

SEQ ID NO: 307818 - DNA, 20 bp, Artificial Sequence
  Description of Artificial Sequence: Synthetic oligonucleotide
  Target: ATXN1; (+) strand; PAM type: YTN; PAM sequence: TTG
gtcaggaaactccagccata

SEQ ID NO: 307819 - DNA, 20 bp, Artificial Sequence
  Description of Artificial Sequence: Synthetic oligonucleotide
  Target: ATXN1; (+) strand; PAM type: YTN; PAM sequence: CTC
cagccataatattcagaata

SEQ ID NO: 307820 - DNA, 20 bp, Artificial Sequence
  Description of Artificial Sequence: Synthetic oligonucleotide
  Target: ATXN1; (+) strand; PAM type: YTN; PAM sequence: TTC
agaataacacactagaattt

SEQ ID NO: 307821 - DNA, 20 bp, Artificial Sequence
  Description of Artificial Sequence: Synthetic oligonucleotide
  Target: ATXN1; (+) strand; PAM type: YTN; PAM sequence: CTA
gaattttagctgagcaagat

SEQ ID NO: 307822 - DNA, 20 bp, Artificial Sequence
  Description of Artificial Sequence: Synthetic oligonucleotide
  Target: ATXN1; (+) strand; PAM type: YTN; PAM sequence: TTT
tagctgagcaagatgaaatc

SEQ ID NO: 307823 - DNA, 20 bp, Artificial Sequence
  Description of Artificial Sequence: Synthetic oligonucleotide
  Target: ATXN1; (+) strand; PAM type: YTN; PAM sequence: TTT
agctgagcaagatgaaatcc

SEQ ID NO: 307824 - DNA, 20 bp, Artificial Sequence
  Description of Artificial Sequence: Synthetic oligonucleotide
  Target: ATXN1; (+) strand; PAM type: YTN; PAM sequence: TTA
gctgagcaagatgaaatccc

SEQ ID NO: 307825 - DNA, 20 bp, Artificial Sequence
  Description of Artificial Sequence: Synthetic oligonucleotide
  Target: ATXN1; (+) strand; PAM type: YTN; PAM sequence: CTG
agcaagatgaaatcccagaa

SEQ ID NO: 307826 - DNA, 20 bp, Artificial Sequence
  Description of Artificial Sequence: Synthetic oligonucleotide
  Target: ATXN1; (+) strand; PAM type: YTN; PAM sequence: TTC
agcaataagacagaaaagat

SEQ ID NO: 307827 - DNA, 20 bp, Artificial Sequence
  Description of Artificial Sequence: Synthetic oligonucleotide
  Target: ATXN1; (+) strand; PAM type: YTN; PAM sequence: TTG
gaactgtttggaactgtttt

SEQ ID NO: 307828 - DNA, 20 bp, Artificial Sequence
  Description of Artificial Sequence: Synthetic oligonucleotide
  Target: ATXN1; (+) strand; PAM type: YTN; PAM sequence: CTG
tttggaactgttttatattt

SEQ ID NO: 307829 - DNA, 20 bp, Artificial Sequence
  Description of Artificial Sequence: Synthetic oligonucleotide
  Target: ATXN1; (+) strand; PAM type: YTN; PAM sequence: TTT
ggaactgttttatattttta

SEQ ID NO: 307830 - DNA, 20 bp, Artificial Sequence
  Description of Artificial Sequence: Synthetic oligonucleotide
  Target: ATXN1; (+) strand; PAM type: YTN; PAM sequence: TTG
gaactgttttatatttttaa

SEQ ID NO: 307831 - DNA, 20 bp, Artificial Sequence
  Description of Artificial Sequence: Synthetic oligonucleotide
  Target: ATXN1; (+) strand; PAM type: YTN; PAM sequence: CTG
ttttatatttttaagtgctg

SEQ ID NO: 307832 - DNA, 20 bp, Artificial Sequence
  Description of Artificial Sequence: Synthetic oligonucleotide
  Target: ATXN1; (+) strand; PAM type: YTN; PAM sequence: TTT
tatatttttaagtgctgtgc

SEQ ID NO: 307833 - DNA, 20 bp, Artificial Sequence
  Description of Artificial Sequence: Synthetic oligonucleotide
  Target: ATXN1; (+) strand; PAM type: YTN; PAM sequence: TTT
atatttttaagtgctgtgca

SEQ ID NO: 307834 - DNA, 20 bp, Artificial Sequence
  Description of Artificial Sequence: Synthetic oligonucleotide
  Target: ATXN1; (+) strand; PAM type: YTN; PAM sequence: TTA
tatttttaagtgctgtgcat

SEQ ID NO: 307835 - DNA, 20 bp, Artificial Sequence
  Description of Artificial Sequence: Synthetic oligonucleotide
  Target: ATXN1; (+) strand; PAM type: YTN; PAM sequence: TTT
ttaagtgctgtgcatttaca

SEQ ID NO: 307836 - DNA, 20 bp, Artificial Sequence
  Description of Artificial Sequence: Synthetic oligonucleotide
  Target: ATXN1; (+) strand; PAM type: YTN; PAM sequence: TTT
taagtgctgtgcatttacaa

SEQ ID NO: 307837 - DNA, 20 bp, Artificial Sequence
  Description of Artificial Sequence: Synthetic oligonucleotide
  Target: ATXN1; (+) strand; PAM type: YTN; PAM sequence: TTT
aagtgctgtgcatttacaaa

SEQ ID NO: 307838 - DNA, 20 bp, Artificial Sequence
  Description of Artificial Sequence: Synthetic oligonucleotide
  Target: ATXN1; (+) strand; PAM type: YTN; PAM sequence: TTA
agtgctgtgcatttacaaaa

SEQ ID NO: 307839 - DNA, 20 bp, Artificial Sequence
  Description of Artificial Sequence: Synthetic oligonucleotide
  Target: ATXN1; (+) strand; PAM type: YTN; PAM sequence: CTG
tgcatttacaaaacaaaaaa

SEQ ID NO: 307840 - DNA, 20 bp, Artificial Sequence
  Description of Artificial Sequence: Synthetic oligonucleotide
  Target: ATXN1; (+) strand; PAM type: YTN; PAM sequence: TTT
acaaaacaaaaaaaaaagta

SEQ ID NO: 307841 - DNA, 20 bp, Artificial Sequence
  Description of Artificial Sequence: Synthetic oligonucleotide
  Target: ATXN1; (+) strand; PAM type: YTN; PAM sequence: TTA
caaaacaaaaaaaaaagtag

SEQ ID NO: 307842 - DNA, 20 bp, Artificial Sequence
  Description of Artificial Sequence: Synthetic oligonucleotide
  Target: ATXN1; (+) strand; PAM type: YTN; PAM sequence: TTT
ctaagtaagaaaacaataaa

SEQ ID NO: 307843 - DNA, 20 bp, Artificial Sequence
  Description of Artificial Sequence: Synthetic oligonucleotide
  Target: ATXN1; (+) strand; PAM type: YTN; PAM sequence: TTC
taagtaagaaaacaataaac

SEQ ID NO: 307844 - DNA, 20 bp, Artificial Sequence
  Description of Artificial Sequence: Synthetic oligonucleotide
  Target: ATXN1; (+) strand; PAM type: YTN; PAM sequence: CTA
agtaagaaaacaataaaccc

SEQ ID NO: 307845 - DNA, 20 bp, Artificial Sequence
  Description of Artificial Sequence: Synthetic oligonucleotide
  Target: ATXN1; (+) strand; PAM type: YTN; PAM sequence: TTA
gttataaacacagaaagaaa

SEQ ID NO: 307846 - DNA, 20 bp, Artificial Sequence
  Description of Artificial Sequence: Synthetic oligonucleotide
  Target: ATXN1; (+) strand; PAM type: YTN; PAM sequence: TTA
taaacacagaaagaaaacaa

SEQ ID NO: 307847 - DNA, 20 bp, Artificial Sequence
  Description of Artificial Sequence: Synthetic oligonucleotide
  Target: ATXN1; (+) strand; PAM type: YTN; PAM sequence: TTA
agaattttgaaagcagaata

SEQ ID NO: 307848 - DNA, 20 bp, Artificial Sequence
  Description of Artificial Sequence: Synthetic oligonucleotide
  Target: ATXN1; (+) strand; PAM type: YTN; PAM sequence: TTT
tgaaagcagaatagggctaa

SEQ ID NO: 307849 - DNA, 20 bp, Artificial Sequence
  Description of Artificial Sequence: Synthetic oligonucleotide
  Target: ATXN1; (+) strand; PAM type: YTN; PAM sequence: TTT
gaaagcagaatagggctaaa

SEQ ID NO: 307850 - DNA, 20 bp, Artificial Sequence
  Description of Artificial Sequence: Synthetic oligonucleotide
  Target: ATXN1; (+) strand; PAM type: YTN; PAM sequence: TTG
aaagcagaatagggctaaaa

SEQ ID NO: 307851 - DNA, 20 bp, Artificial Sequence
  Description of Artificial Sequence: Synthetic oligonucleotide
  Target: ATXN1; (+) strand; PAM type: YTN; PAM sequence: CTA
aaacctaacagaactttatt

SEQ ID NO: 307852 - DNA, 20 bp, Artificial Sequence
  Description of Artificial Sequence: Synthetic oligonucleotide
  Target: ATXN1; (+) strand; PAM type: YTN; PAM sequence: CTA
acagaactttattcctcgag

SEQ ID NO: 307853 - DNA, 20 bp, Artificial Sequence
  Description of Artificial Sequence: Synthetic oligonucleotide
  Target: ATXN1; (+) strand; PAM type: YTN; PAM sequence: CTT
tattcctcgagaagctttct

SEQ ID NO: 307854 - DNA, 20 bp, Artificial Sequence
  Description of Artificial Sequence: Synthetic oligonucleotide
  Target: ATXN1; (+) strand; PAM type: YTN; PAM sequence: TTT
attcctcgagaagctttctc

SEQ ID NO: 307855 - DNA, 20 bp, Artificial Sequence
  Description of Artificial Sequence: Synthetic oligonucleotide
  Target: ATXN1; (+) strand; PAM type: YTN; PAM sequence: TTA
ttcctcgagaagctttctct

SEQ ID NO: 307856 - DNA, 20 bp, Artificial Sequence
  Description of Artificial Sequence: Synthetic oligonucleotide
  Target: ATXN1; (+) strand; PAM type: YTN; PAM sequence: TTC
ctcgagaagctttctcttga

SEQ ID NO: 307857 - DNA, 20 bp, Artificial Sequence
  Description of Artificial Sequence: Synthetic oligonucleotide
  Target: ATXN1; (+) strand; PAM type: YTN; PAM sequence: CTC
gagaagctttctcttgatca

SEQ ID NO: 307858 - DNA, 20 bp, Artificial Sequence
  Description of Artificial Sequence: Synthetic oligonucleotide
  Target: ATXN1; (+) strand; PAM type: YTN; PAM sequence: CTT
tctcttgatcaatagcccta

SEQ ID NO: 307859 - DNA, 20 bp, Artificial Sequence
  Description of Artificial Sequence: Synthetic oligonucleotide
  Target: ATXN1; (+) strand; PAM type: YTN; PAM sequence: TTT
ctcttgatcaatagccctaa

SEQ ID NO: 307860 - DNA, 20 bp, Artificial Sequence
  Description of Artificial Sequence: Synthetic oligonucleotide
  Target: ATXN1; (+) strand; PAM type: YTN; PAM sequence: TTC
tcttgatcaatagccctaaa

SEQ ID NO: 307861 - DNA, 20 bp, Artificial Sequence
  Description of Artificial Sequence: Synthetic oligonucleotide
  Target: ATXN1; (+) strand; PAM type: YTN; PAM sequence: CTC
ttgatcaatagccctaaaat

SEQ ID NO: 307862 - DNA, 20 bp, Artificial Sequence
  Description of Artificial Sequence: Synthetic oligonucleotide
  Target: ATXN1; (+) strand; PAM type: YTN; PAM sequence: CTT
gatcaatagccctaaaattt

SEQ ID NO: 307863 - DNA, 20 bp, Artificial Sequence
  Description of Artificial Sequence: Synthetic oligonucleotide
  Target: ATXN1; (+) strand; PAM type: YTN; PAM sequence: TTG
atcaatagccctaaaatttt

SEQ ID NO: 307864 - DNA, 20 bp, Artificial Sequence
  Description of Artificial Sequence: Synthetic oligonucleotide
  Target: ATXN1; (+) strand; PAM type: YTN; PAM sequence: CTA
aaattttaagacattctgta

SEQ ID NO: 307865 - DNA, 20 bp, Artificial Sequence
  Description of Artificial Sequence: Synthetic oligonucleotide
  Target: ATXN1; (+) strand; PAM type: YTN; PAM sequence: TTT
taagacattctgtatttaag

SEQ ID NO: 307866 - DNA, 20 bp, Artificial Sequence
  Description of Artificial Sequence: Synthetic oligonucleotide
  Target: ATXN1; (+) strand; PAM type: YTN; PAM sequence: TTT
aagacattctgtatttaagt

SEQ ID NO: 307867 - DNA, 20 bp, Artificial Sequence
  Description of Artificial Sequence: Synthetic oligonucleotide
  Target: ATXN1; (+) strand; PAM type: YTN; PAM sequence: TTA
agacattctgtatttaagtc

SEQ ID NO: 307868 - DNA, 20 bp, Artificial Sequence
  Description of Artificial Sequence: Synthetic oligonucleotide
  Target: ATXN1; (+) strand; PAM type: YTN; PAM sequence: TTC
tgtatttaagtccttaatgt

SEQ ID NO: 307869 - DNA, 20 bp, Artificial Sequence
  Description of Artificial Sequence: Synthetic oligonucleotide
  Target: ATXN1; (+) strand; PAM type: YTN; PAM sequence: CTG
tatttaagtccttaatgtac

SEQ ID NO: 307870 - DNA, 20 bp, Artificial Sequence
  Description of Artificial Sequence: Synthetic oligonucleotide
  Target: ATXN1; (+) strand; PAM type: YTN; PAM sequence: TTT
aagtccttaatgtacttgga

SEQ ID NO: 307871 - DNA, 20 bp, Artificial Sequence
  Description of Artificial Sequence: Synthetic oligonucleotide
  Target: ATXN1; (+) strand; PAM type: YTN; PAM sequence: TTA
agtccttaatgtacttggaa

SEQ ID NO: 307872 - DNA, 20 bp, Artificial Sequence
  Description of Artificial Sequence: Synthetic oligonucleotide
  Target: ATXN1; (+) strand; PAM type: YTN; PAM sequence: CTT
aatgtacttggaaaacctca

SEQ ID NO: 307873 - DNA, 20 bp, Artificial Sequence
  Description of Artificial Sequence: Synthetic oligonucleotide
  Target: ATXN1; (+) strand; PAM type: YTN; PAM sequence: TTA
atgtacttggaaaacctcag

SEQ ID NO: 307874 - DNA, 20 bp, Artificial Sequence
  Description of Artificial Sequence: Synthetic oligonucleotide
  Target: ATXN1; (+) strand; PAM type: YTN; PAM sequence: CTT
ggaaaacctcagagtctact

SEQ ID NO: 307875 - DNA, 20 bp, Artificial Sequence
  Description of Artificial Sequence: Synthetic oligonucleotide
  Target: ATXN1; (+) strand; PAM type: YTN; PAM sequence: TTG
gaaaacctcagagtctactg

SEQ ID NO: 307876 - DNA, 20 bp, Artificial Sequence
  Description of Artificial Sequence: Synthetic oligonucleotide
  Target: ATXN1; (+) strand; PAM type: YTN; PAM sequence: CTC
agagtctactgaatcataca

SEQ ID NO: 307877 - DNA, 20 bp, Artificial Sequence
  Description of Artificial Sequence: Synthetic oligonucleotide
  Target: ATXN1; (+) strand; PAM type: YTN; PAM sequence: CTA
ctgaatcatacaggccacga

SEQ ID NO: 307878 - DNA, 20 bp, Artificial Sequence
  Description of Artificial Sequence: Synthetic oligonucleotide
  Target: ATXN1; (+) strand; PAM type: YTN; PAM sequence: CTG
aatcatacaggccacgaaga

SEQ ID NO: 307879 - DNA, 20 bp, Artificial Sequence
  Description of Artificial Sequence: Synthetic oligonucleotide
  Target: ATXN1; (+) strand; PAM type: YTN; PAM sequence: TTT
caggagtaatagatgttgct

SEQ ID NO: 307880 - DNA, 20 bp, Artificial Sequence
  Description of Artificial Sequence: Synthetic oligonucleotide
  Target: ATXN1; (+) strand; PAM type: YTN; PAM sequence: TTC
aggagtaatagatgttgcta

SEQ ID NO: 307881 - DNA, 20 bp, Artificial Sequence
  Description of Artificial Sequence: Synthetic oligonucleotide
  Target: ATXN1; (+) strand; PAM type: YTN; PAM sequence: TTG
ctaaaaattacatttgcagc

SEQ ID NO: 307882 - DNA, 20 bp, Artificial Sequence
  Description of Artificial Sequence: Synthetic oligonucleotide
  Target: ATXN1; (+) strand; PAM type: YTN; PAM sequence: CTA
aaaattacatttgcagcgaa

SEQ ID NO: 307883 - DNA, 20 bp, Artificial Sequence
  Description of Artificial Sequence: Synthetic oligonucleotide
  Target: ATXN1; (+) strand; PAM type: YTN; PAM sequence: TTA
catttgcagcgaatccagga

SEQ ID NO: 307884 - DNA, 20 bp, Artificial Sequence
  Description of Artificial Sequence: Synthetic oligonucleotide
  Target: ATXN1; (+) strand; PAM type: YTN; PAM sequence: TTT
gcagcgaatccaggaccaat

SEQ ID NO: 307885 - DNA, 20 bp, Artificial Sequence
  Description of Artificial Sequence: Synthetic oligonucleotide
  Target: ATXN1; (+) strand; PAM type: YTN; PAM sequence: TTG
cagcgaatccaggaccaatg

SEQ ID NO: 307886 - DNA, 20 bp, Artificial Sequence
  Description of Artificial Sequence: Synthetic oligonucleotide
  Target: ATXN1; (+) strand; PAM type: YTN; PAM sequence: CTG
ggaatttaaaaaacaaaaca

SEQ ID NO: 307887 - DNA, 20 bp, Artificial Sequence
  Description of Artificial Sequence: Synthetic oligonucleotide
  Target: ATXN1; (+) strand; PAM type: YTN; PAM sequence: TTT
aaaaaacaaaacaaaacaat

SEQ ID NO: 307888 - DNA, 20 bp, Artificial Sequence
  Description of Artificial Sequence: Synthetic oligonucleotide
  Target: ATXN1; (+) strand; PAM type: YTN; PAM sequence: TTA
aaaaacaaaacaaaacaata

SEQ ID NO: 307889 - DNA, 20 bp, Artificial Sequence
  Description of Artificial Sequence: Synthetic oligonucleotide
  Target: ATXN1; (+) strand; PAM type: YTN; PAM sequence: CTA
atttctccttgaggagagta

SEQ ID NO: 307890 - DNA, 20 bp, Artificial Sequence
  Description of Artificial Sequence: Synthetic oligonucleotide
  Target: ATXN1; (+) strand; PAM type: YTN; PAM sequence: TTT
ctccttgaggagagtagaaa

SEQ ID NO: 307891 - DNA, 20 bp, Artificial Sequence
  Description of Artificial Sequence: Synthetic oligonucleotide
  Target: ATXN1; (+) strand; PAM type: YTN; PAM sequence: TTC
tccttgaggagagtagaaat

SEQ ID NO: 307892 - DNA, 20 bp, Artificial Sequence
  Description of Artificial Sequence: Synthetic oligonucleotide
  Target: ATXN1; (+) strand; PAM type: YTN; PAM sequence: CTC
cttgaggagagtagaaatgg

SEQ ID NO: 307893 - DNA, 20 bp, Artificial Sequence
  Description of Artificial Sequence: Synthetic oligonucleotide
  Target: ATXN1; (+) strand; PAM type: YTN; PAM sequence: CTT
gaggagagtagaaatggaga

SEQ ID NO: 307894 - DNA, 20 bp, Artificial Sequence
  Description of Artificial Sequence: Synthetic oligonucleotide
  Target: ATXN1; (+) strand; PAM type: YTN; PAM sequence: TTG
aggagagtagaaatggagaa

SEQ ID NO: 307895 - DNA, 20 bp, Artificial Sequence
  Description of Artificial Sequence: Synthetic oligonucleotide
  Target: ATXN1; (+) strand; PAM type: YTN; PAM sequence: CTT
cctttgctgggggctctcaa

SEQ ID NO: 307896 - DNA, 20 bp, Artificial Sequence
  Description of Artificial Sequence: Synthetic oligonucleotide
  Target: ATXN1; (+) strand; PAM type: YTN; PAM sequence: TTC
ctttgctgggggctctcaat

SEQ ID NO: 307897 - DNA, 20 bp, Artificial Sequence
  Description of Artificial Sequence: Synthetic oligonucleotide
  Target: ATXN1; (+) strand; PAM type: YTN; PAM sequence: CTT
tgctgggggctctcaattct

SEQ ID NO: 307898 - DNA, 20 bp, Artificial Sequence
  Description of Artificial Sequence: Synthetic oligonucleotide
  Target: ATXN1; (+) strand; PAM type: YTN; PAM sequence: TTT
gctgggggctctcaattctg

SEQ ID NO: 307899 - DNA, 20 bp, Artificial Sequence
  Description of Artificial Sequence: Synthetic oligonucleotide
  Target: ATXN1; (+) strand; PAM type: YTN; PAM sequence: TTG
ctgggggctctcaattctga

SEQ ID NO: 307900 - DNA, 20 bp, Artificial Sequence
  Description of Artificial Sequence: Synthetic oligonucleotide
  Target: ATXN1; (+) strand; PAM type: YTN; PAM sequence: CTG
ggggctctcaattctgaagc

SEQ ID NO: 307901 - DNA, 20 bp, Artificial Sequence
  Description of Artificial Sequence: Synthetic oligonucleotide
  Target: ATXN1; (+) strand; PAM type: YTN; PAM sequence: CTC
tcaattctgaagctcagttc

SEQ ID NO: 307902 - DNA, 20 bp, Artificial Sequence
  Description of Artificial Sequence: Synthetic oligonucleotide
  Target: ATXN1; (+) strand; PAM type: YTN; PAM sequence: CTC
aattctgaagctcagttcct

SEQ ID NO: 307903 - DNA, 20 bp, Artificial Sequence
  Description of Artificial Sequence: Synthetic oligonucleotide
  Target: ATXN1; (+) strand; PAM type: YTN; PAM sequence: TTC
tgaagctcagttccttaaac

SEQ ID NO: 307904 - DNA, 20 bp, Artificial Sequence
  Description of Artificial Sequence: Synthetic oligonucleotide
  Target: ATXN1; (+) strand; PAM type: YTN; PAM sequence: CTG
aagctcagttccttaaaccg

SEQ ID NO: 307905 - DNA, 20 bp, Artificial Sequence
  Description of Artificial Sequence: Synthetic oligonucleotide
  Target: ATXN1; (+) strand; PAM type: YTN; PAM sequence: CTC
agttccttaaaccgctaaca

SEQ ID NO: 307906 - DNA, 20 bp, Artificial Sequence
  Description of Artificial Sequence: Synthetic oligonucleotide
  Target: ATXN1; (+) strand; PAM type: YTN; PAM sequence: TTC
cttaaaccgctaacactggc

SEQ ID NO: 307907 - DNA, 20 bp, Artificial Sequence
  Description of Artificial Sequence: Synthetic oligonucleotide
  Target: ATXN1; (+) strand; PAM type: YTN; PAM sequence: CTT
aaaccgctaacactggctat

SEQ ID NO: 307908 - DNA, 20 bp, Artificial Sequence
  Description of Artificial Sequence: Synthetic oligonucleotide
  Target: ATXN1; (+) strand; PAM type: YTN; PAM sequence: TTA
aaccgctaacactggctatt

SEQ ID NO: 307909 - DNA, 20 bp, Artificial Sequence
  Description of Artificial Sequence: Synthetic oligonucleotide
  Target: ATXN1; (+) strand; PAM type: YTN; PAM sequence: CTA
acactggctattagctttca

SEQ ID NO: 307910 - DNA, 20 bp, Artificial Sequence
  Description of Artificial Sequence: Synthetic oligonucleotide
  Target: ATXN1; (+) strand; PAM type: YTN; PAM sequence: CTG
gctattagctttcagctggg

SEQ ID NO: 307911 - DNA, 20 bp, Artificial Sequence
  Description of Artificial Sequence: Synthetic oligonucleotide
  Target: ATXN1; (+) strand; PAM type: YTN; PAM sequence: CTA
ttagctttcagctgggctgg

SEQ ID NO: 307912 - DNA, 20 bp, Artificial Sequence
  Description of Artificial Sequence: Synthetic oligonucleotide
  Target: ATXN1; (+) strand; PAM type: YTN; PAM sequence: TTA
gctttcagctgggctggttg

SEQ ID NO: 307913 - DNA, 20 bp, Artificial Sequence
  Description of Artificial Sequence: Synthetic oligonucleotide
  Target: ATXN1; (+) strand; PAM type: YTN; PAM sequence: CTT
tcagctgggctggttgacat

SEQ ID NO: 307914 - DNA, 20 bp, Artificial Sequence
  Description of Artificial Sequence: Synthetic oligonucleotide
  Target: ATXN1; (+) strand; PAM type: YTN; PAM sequence: TTT
cagctgggctggttgacatg

SEQ ID NO: 307915 - DNA, 20 bp, Artificial Sequence
  Description of Artificial Sequence: Synthetic oligonucleotide
  Target: ATXN1; (+) strand; PAM type: YTN; PAM sequence: TTC
agctgggctggttgacatgg

SEQ ID NO: 307916 - DNA, 20 bp, Artificial Sequence
  Description of Artificial Sequence: Synthetic oligonucleotide
  Target: ATXN1; (+) strand; PAM type: YTN; PAM sequence: CTG
ggctggttgacatggcaaga

SEQ ID NO: 307917 - DNA, 20 bp, Artificial Sequence
  Description of Artificial Sequence: Synthetic oligonucleotide
  Target: ATXN1; (+) strand; PAM type: YTN; PAM sequence: CTG
gttgacatggcaagaccctt

SEQ ID NO: 307918 - DNA, 20 bp, Artificial Sequence
  Description of Artificial Sequence: Synthetic oligonucleotide
  Target: ATXN1; (+) strand; PAM type: YTN; PAM sequence: TTG
acatggcaagacccttagaa

SEQ ID NO: 307919 - DNA, 20 bp, Artificial Sequence
  Description of Artificial Sequence: Synthetic oligonucleotide
  Target: ATXN1; (+) strand; PAM type: YTN; PAM sequence: CTT
agaagggcacatccatattt

SEQ ID NO: 307920 - DNA, 20 bp, Artificial Sequence
  Description of Artificial Sequence: Synthetic oligonucleotide
  Target: ATXN1; (+) strand; PAM type: YTN; PAM sequence: TTA
gaagggcacatccatatttg

SEQ ID NO: 307921 - DNA, 20 bp, Artificial Sequence
  Description of Artificial Sequence: Synthetic oligonucleotide
  Target: ATXN1; (+) strand; PAM type: YTN; PAM sequence: TTT
gtgggtaattatggaatttc

SEQ ID NO: 307922 - DNA, 20 bp, Artificial Sequence
  Description of Artificial Sequence: Synthetic oligonucleotide
  Target: ATXN1; (+) strand; PAM type: YTN; PAM sequence: TTG
tgggtaattatggaatttca

SEQ ID NO: 307923 - DNA, 20 bp, Artificial Sequence
  Description of Artificial Sequence: Synthetic oligonucleotide
  Target: ATXN1; (+) strand; PAM type: YTN; PAM sequence: TTA
tggaatttcaacaattggaa

SEQ ID NO: 307924 - DNA, 20 bp, Artificial Sequence
  Description of Artificial Sequence: Synthetic oligonucleotide
  Target: ATXN1; (+) strand; PAM type: YTN; PAM sequence: TTT
caacaattggaagcaactca

SEQ ID NO: 307925 - DNA, 20 bp, Artificial Sequence
  Description of Artificial Sequence: Synthetic oligonucleotide
  Target: ATXN1; (+) strand; PAM type: YTN; PAM sequence: TTC
aacaattggaagcaactcag

SEQ ID NO: 307926 - DNA, 20 bp, Artificial Sequence
  Description of Artificial Sequence: Synthetic oligonucleotide
  Target: ATXN1; (+) strand; PAM type: YTN; PAM sequence: TTG
gaagcaactcagggagccat

SEQ ID NO: 307927 - DNA, 20 bp, Artificial Sequence
  Description of Artificial Sequence: Synthetic oligonucleotide
  Target: ATXN1; (+) strand; PAM type: YTN; PAM sequence: CTC
agggagccatcatgaggaga

SEQ ID NO: 307928 - DNA, 20 bp, Artificial Sequence
  Description of Artificial Sequence: Synthetic oligonucleotide
  Target: ATXN1; (+) strand; PAM type: YTN; PAM sequence: CTG
tttcagaaagtccaaaataa

SEQ ID NO: 307929 - DNA, 20 bp, Artificial Sequence
  Description of Artificial Sequence: Synthetic oligonucleotide
  Target: ATXN1; (+) strand; PAM type: YTN; PAM sequence: TTT
cagaaagtccaaaataaagt

SEQ ID NO: 307930 - DNA, 20 bp, Artificial Sequence
  Description of Artificial Sequence: Synthetic oligonucleotide
  Target: ATXN1; (+) strand; PAM type: YTN; PAM sequence: TTC
agaaagtccaaaataaagtg

SEQ ID NO: 307931 - DNA, 20 bp, Artificial Sequence
  Description of Artificial Sequence: Synthetic oligonucleotide
  Target: ATXN1; (+) strand; PAM type: YTN; PAM sequence: CTT
tattatatacatattcatat

SEQ ID NO: 307932 - DNA, 20 bp, Artificial Sequence
  Description of Artificial Sequence: Synthetic oligonucleotide
  Target: ATXN1; (+) strand; PAM type: YTN; PAM sequence: TTT
attatatacatattcatatt

SEQ ID NO: 307933 - DNA, 20 bp, Artificial Sequence
  Description of Artificial Sequence: Synthetic oligonucleotide
  Target: ATXN1; (+) strand; PAM type: YTN; PAM sequence: TTA
ttatatacatattcatattc

SEQ ID NO: 307934 - DNA, 20 bp, Artificial Sequence
  Description of Artificial Sequence: Synthetic oligonucleotide
  Target: ATXN1; (+) strand; PAM type: YTN; PAM sequence: TTA
tatacatattcatattcctc

SEQ ID NO: 307935 - DNA, 20 bp, Artificial Sequence
  Description of Artificial Sequence: Synthetic oligonucleotide
  Target: ATXN1; (+) strand; PAM type: YTN; PAM sequence: TTC
atattcctcctctattatgc

SEQ ID NO: 307936 - DNA, 20 bp, Artificial Sequence
  Description of Artificial Sequence: Synthetic oligonucleotide
  Target: ATXN1; (+) strand; PAM type: YTN; PAM sequence: TTC
ctcctctattatgcaaatag

SEQ ID NO: 307937 - DNA, 20 bp, Artificial Sequence
  Description of Artificial Sequence: Synthetic oligonucleotide
  Target: ATXN1; (+) strand; PAM type: YTN; PAM sequence: CTC
ctctattatgcaaataggtg

SEQ ID NO: 307938 - DNA, 20 bp, Artificial Sequence
  Description of Artificial Sequence: Synthetic oligonucleotide
  Target: ATXN1; (+) strand; PAM type: YTN; PAM sequence: CTC
tattatgcaaataggtgaag

SEQ ID NO: 307939 - DNA, 20 bp, Artificial Sequence
  Description of Artificial Sequence: Synthetic oligonucleotide
  Target: ATXN1; (+) strand; PAM type: YTN; PAM sequence: CTA
ttatgcaaataggtgaagta

SEQ ID NO: 307940 - DNA, 20 bp, Artificial Sequence
  Description of Artificial Sequence: Synthetic oligonucleotide
  Target: ATXN1; (+) strand; PAM type: YTN; PAM sequence: TTA
tgcaaataggtgaagtatgt

SEQ ID NO: 307941 - DNA, 20 bp, Artificial Sequence
  Description of Artificial Sequence: Synthetic oligonucleotide
  Target: ATXN1; (+) strand; PAM type: YTN; PAM sequence: TTG
gcaaaagactagaattttaa

SEQ ID NO: 307942 - DNA, 20 bp, Artificial Sequence
  Description of Artificial Sequence: Synthetic oligonucleotide
  Target: ATXN1; (+) strand; PAM type: YTN; PAM sequence: CTA
gaattttaaaaaaccaggat

SEQ ID NO: 307943 - DNA, 20 bp, Artificial Sequence
  Description of Artificial Sequence: Synthetic oligonucleotide
  Target: ATXN1; (+) strand; PAM type: YTN; PAM sequence: TTT
taaaaaaccaggattttaaa

SEQ ID NO: 307944 - DNA, 20 bp, Artificial Sequence
  Description of Artificial Sequence: Synthetic oligonucleotide
  Target: ATXN1; (+) strand; PAM type: YTN; PAM sequence: TTT
aaaaaaccaggattttaaaa

SEQ ID NO: 307945 - DNA, 20 bp, Artificial Sequence
  Description of Artificial Sequence: Synthetic oligonucleotide
  Target: ATXN1; (+) strand; PAM type: YTN; PAM sequence: TTA
aaaaaccaggattttaaaaa

SEQ ID NO: 307946 - DNA, 20 bp, Artificial Sequence
  Description of Artificial Sequence: Synthetic oligonucleotide
  Target: ATXN1; (+) strand; PAM type: YTN; PAM sequence: TTT
taaaaaaagcacatctatga

SEQ ID NO: 307947 - DNA, 20 bp, Artificial Sequence
  Description of Artificial Sequence: Synthetic oligonucleotide
  Target: ATXN1; (+) strand; PAM type: YTN; PAM sequence: TTT
aaaaaaagcacatctatgac

SEQ ID NO: 307948 - DNA, 20 bp, Artificial Sequence
  Description of Artificial Sequence: Synthetic oligonucleotide
  Target: ATXN1; (+) strand; PAM type: YTN; PAM sequence: TTA
aaaaaagcacatctatgact

SEQ ID NO: 307949 - DNA, 20 bp, Artificial Sequence
  Description of Artificial Sequence: Synthetic oligonucleotide
  Target: ATXN1; (+) strand; PAM type: YTN; PAM sequence: CTA
tgactgaattatttatagtt

SEQ ID NO: 307950 - DNA, 20 bp, Artificial Sequence
  Description of Artificial Sequence: Synthetic oligonucleotide
  Target: ATXN1; (+) strand; PAM type: YTN; PAM sequence: CTG
aattatttatagttgcaaat

SEQ ID NO: 307951 - DNA, 20 bp, Artificial Sequence
  Description of Artificial Sequence: Synthetic oligonucleotide
  Target: ATXN1; (+) strand; PAM type: YTN; PAM sequence: TTA
tttatagttgcaaatggctt

SEQ ID NO: 307952 - DNA, 20 bp, Artificial Sequence
  Description of Artificial Sequence: Synthetic oligonucleotide
  Target: ATXN1; (+) strand; PAM type: YTN; PAM sequence: TTT
atagttgcaaatggcttcat

SEQ ID NO: 307953 - DNA, 20 bp, Artificial Sequence
  Description of Artificial Sequence: Synthetic oligonucleotide
  Target: ATXN1; (+) strand; PAM type: YTN; PAM sequence: TTA
tagttgcaaatggcttcata

SEQ ID NO: 307954 - DNA, 20 bp, Artificial Sequence
  Description of Artificial Sequence: Synthetic oligonucleotide
  Target: ATXN1; (+) strand; PAM type: YTN; PAM sequence: TTG
caaatggcttcataatacca

SEQ ID NO: 307955 - DNA, 20 bp, Artificial Sequence
  Description of Artificial Sequence: Synthetic oligonucleotide
  Target: ATXN1; (+) strand; PAM type: YTN; PAM sequence: CTT
cataataccaacctagtatt

SEQ ID NO: 307956 - DNA, 20 bp, Artificial Sequence
  Description of Artificial Sequence: Synthetic oligonucleotide
  Target: ATXN1; (+) strand; PAM type: YTN; PAM sequence: TTC
ataataccaacctagtatta

SEQ ID NO: 307957 - DNA, 20 bp, Artificial Sequence
  Description of Artificial Sequence: Synthetic oligonucleotide
  Target: ATXN1; (+) strand; PAM type: YTN; PAM sequence: CTA
gtattattactgcaggcact

SEQ ID NO: 307958 - DNA, 20 bp, Artificial Sequence
  Description of Artificial Sequence: Synthetic oligonucleotide
  Target: ATXN1; (+) strand; PAM type: YTN; PAM sequence: TTA
ttactgcaggcactggccct

SEQ ID NO: 307959 - DNA, 20 bp, Artificial Sequence
  Description of Artificial Sequence: Synthetic oligonucleotide
  Target: ATXN1; (+) strand; PAM type: YTN; PAM sequence: TTA
ctgcaggcactggccctggc

SEQ ID NO: 307960 - DNA, 20 bp, Artificial Sequence
  Description of Artificial Sequence: Synthetic oligonucleotide
  Target: ATXN1; (+) strand; PAM type: YTN; PAM sequence: CTG
caggcactggccctggctta

SEQ ID NO: 307961 - DNA, 20 bp, Artificial Sequence
  Description of Artificial Sequence: Synthetic oligonucleotide
  Target: ATXN1; (+) strand; PAM type: YTN; PAM sequence: CTG
gccctggcttagaaatgtta

SEQ ID NO: 307962 - DNA, 20 bp, Artificial Sequence
  Description of Artificial Sequence: Synthetic oligonucleotide
  Target: ATXN1; (+) strand; PAM type: YTN; PAM sequence: CTG
gcttagaaatgttatttcat

SEQ ID NO: 307963 - DNA, 20 bp, Artificial Sequence
  Description of Artificial Sequence: Synthetic oligonucleotide
  Target: ATXN1; (+) strand; PAM type: YTN; PAM sequence: CTT
agaaatgttatttcatttag

SEQ ID NO: 307964 - DNA, 20 bp, Artificial Sequence
  Description of Artificial Sequence: Synthetic oligonucleotide
  Target: ATXN1; (+) strand; PAM type: YTN; PAM sequence: TTA
gaaatgttatttcatttaga

SEQ ID NO: 307965 - DNA, 20 bp, Artificial Sequence
  Description of Artificial Sequence: Synthetic oligonucleotide
  Target: ATXN1; (+) strand; PAM type: YTN; PAM sequence: TTA
tttcatttagaaatgtttct

SEQ ID NO: 307966 - DNA, 20 bp, Artificial Sequence
  Description of Artificial Sequence: Synthetic oligonucleotide
  Target: ATXN1; (+) strand; PAM type: YTN; PAM sequence: TTT
catttagaaatgtttctatt

SEQ ID NO: 307967 - DNA, 20 bp, Artificial Sequence
  Description of Artificial Sequence: Synthetic oligonucleotide
  Target: ATXN1; (+) strand; PAM type: YTN; PAM sequence: TTC
atttagaaatgtttctattt

SEQ ID NO: 307968 - DNA, 20 bp, Artificial Sequence
  Description of Artificial Sequence: Synthetic oligonucleotide
  Target: ATXN1; (+) strand; PAM type: YTN; PAM sequence: TTT
agaaatgtttctatttgttg

SEQ ID NO: 307969 - DNA, 20 bp, Artificial Sequence
  Description of Artificial Sequence: Synthetic oligonucleotide
  Target: ATXN1; (+) strand; PAM type: YTN; PAM sequence: TTA
gaaatgtttctatttgttgt

SEQ ID NO: 307970 - DNA, 20 bp, Artificial Sequence
  Description of Artificial Sequence: Synthetic oligonucleotide
  Target: ATXN1; (+) strand; PAM type: YTN; PAM sequence: TTT
ctatttgttgtaacactagc

SEQ ID NO: 307971 - DNA, 20 bp, Artificial Sequence
  Description of Artificial Sequence: Synthetic oligonucleotide
  Target: ATXN1; (+) strand; PAM type: YTN; PAM sequence: TTC
tatttgttgtaacactagcc

SEQ ID NO: 307972 - DNA, 20 bp, Artificial Sequence
  Description of Artificial Sequence: Synthetic oligonucleotide
  Target: ATXN1; (+) strand; PAM type: YTN; PAM sequence: CTA
tttgttgtaacactagccac

SEQ ID NO: 307973 - DNA, 20 bp, Artificial Sequence
  Description of Artificial Sequence: Synthetic oligonucleotide
  Target: ATXN1; (+) strand; PAM type: YTN; PAM sequence: TTT
gttgtaacactagccactgt

SEQ ID NO: 307974 - DNA, 20 bp, Artificial Sequence
  Description of Artificial Sequence: Synthetic oligonucleotide
  Target: ATXN1; (+) strand; PAM type: YTN; PAM sequence: TTG
ttgtaacactagccactgtg

SEQ ID NO: 307975 - DNA, 20 bp, Artificial Sequence
  Description of Artificial Sequence: Synthetic oligonucleotide
  Target: ATXN1; (+) strand; PAM type: YTN; PAM sequence: TTG
taacactagccactgtgatg

SEQ ID NO: 307976 - DNA, 20 bp, Artificial Sequence
  Description of Artificial Sequence: Synthetic oligonucleotide
  Target: ATXN1; (+) strand; PAM type: YTN; PAM sequence: CTA
gccactgtgatggggtttga

SEQ ID NO: 307977 - DNA, 20 bp, Artificial Sequence
  Description of Artificial Sequence: Synthetic oligonucleotide
  Target: ATXN1; (+) strand; PAM type: YTN; PAM sequence: CTG
tgatggggtttgacccgtgt

SEQ ID NO: 307978 - DNA, 20 bp, Artificial Sequence
  Description of Artificial Sequence: Synthetic oligonucleotide
  Target: ATXN1; (+) strand; PAM type: YTN; PAM sequence: TTT
gacccgtgtctttgtccata

SEQ ID NO: 307979 - DNA, 20 bp, Artificial Sequence
  Description of Artificial Sequence: Synthetic oligonucleotide
  Target: ATXN1; (+) strand; PAM type: YTN; PAM sequence: TTG
acccgtgtctttgtccataa

SEQ ID NO: 307980 - DNA, 20 bp, Artificial Sequence
  Description of Artificial Sequence: Synthetic oligonucleotide
  Target: ATXN1; (+) strand; PAM type: YTN; PAM sequence: CTT
tgtccataaaacaaccctat

SEQ ID NO: 307981 - DNA, 20 bp, Artificial Sequence
  Description of Artificial Sequence: Synthetic oligonucleotide
  Target: ATXN1; (+) strand; PAM type: YTN; PAM sequence: TTT
gtccataaaacaaccctata

SEQ ID NO: 307982 - DNA, 20 bp, Artificial Sequence
  Description of Artificial Sequence: Synthetic oligonucleotide
  Target: ATXN1; (+) strand; PAM type: YTN; PAM sequence: TTG
tccataaaacaaccctataa

SEQ ID NO: 307983 - DNA, 20 bp, Artificial Sequence
  Description of Artificial Sequence: Synthetic oligonucleotide
  Target: ATXN1; (+) strand; PAM type: YTN; PAM sequence: CTA
taagatatgtaaacatgaat

SEQ ID NO: 307984 - DNA, 20 bp, Artificial Sequence
  Description of Artificial Sequence: Synthetic oligonucleotide
  Target: ATXN1; (+) strand; PAM type: YTN; PAM sequence: TTC
aattttctttaagtgaaaga

SEQ ID NO: 307985 - DNA, 20 bp, Artificial Sequence
  Description of Artificial Sequence: Synthetic oligonucleotide
  Target: ATXN1; (+) strand; PAM type: YTN; PAM sequence: TTT
tctttaagtgaaagaaagca

SEQ ID NO: 307986 - DNA, 20 bp, Artificial Sequence
  Description of Artificial Sequence: Synthetic oligonucleotide
  Target: ATXN1; (+) strand; PAM type: YTN; PAM sequence: TTT
ctttaagtgaaagaaagcaa

SEQ ID NO: 307987 - DNA, 20 bp, Artificial Sequence
  Description of Artificial Sequence: Synthetic oligonucleotide
  Target: ATXN1; (+) strand; PAM type: YTN; PAM sequence: TTC
tttaagtgaaagaaagcaaa

SEQ ID NO: 307988 - DNA, 20 bp, Artificial Sequence
  Description of Artificial Sequence: Synthetic oligonucleotide
  Target: ATXN1; (+) strand; PAM type: YTN; PAM sequence: CTT
taagtgaaagaaagcaaaaa

SEQ ID NO: 307989 - DNA, 20 bp, Artificial Sequence
  Description of Artificial Sequence: Synthetic oligonucleotide
  Target: ATXN1; (+) strand; PAM type: YTN; PAM sequence: TTT
aagtgaaagaaagcaaaaat

SEQ ID NO: 307990 - DNA, 20 bp, Artificial Sequence
  Description of Artificial Sequence: Synthetic oligonucleotide
  Target: ATXN1; (+) strand; PAM type: YTN; PAM sequence: TTA
agtgaaagaaagcaaaaata

SEQ ID NO: 307991 - DNA, 20 bp, Artificial Sequence
  Description of Artificial Sequence: Synthetic oligonucleotide
  Target: ATXN1; (+) strand; PAM type: YTN; PAM sequence: TTG
tcagaacaagaactgctttc

SEQ ID NO: 307992 - DNA, 20 bp, Artificial Sequence
  Description of Artificial Sequence: Synthetic oligonucleotide
  Target: ATXN1; (+) strand; PAM type: YTN; PAM sequence: CTG
ctttctgtgggatattctag

SEQ ID NO: 307993 - DNA, 20 bp, Artificial Sequence
  Description of Artificial Sequence: Synthetic oligonucleotide
  Target: ATXN1; (+) strand; PAM type: YTN; PAM sequence: CTT
tctgtgggatattctagtta

SEQ ID NO: 307994 - DNA, 20 bp, Artificial Sequence
  Description of Artificial Sequence: Synthetic oligonucleotide
  Target: ATXN1; (+) strand; PAM type: YTN; PAM sequence: TTT
ctgtgggatattctagttaa

SEQ ID NO: 307995 - DNA, 20 bp, Artificial Sequence
  Description of Artificial Sequence: Synthetic oligonucleotide
  Target: ATXN1; (+) strand; PAM type: YTN; PAM sequence: TTC
tgtgggatattctagttaaa

SEQ ID NO: 307996 - DNA, 20 bp, Artificial Sequence
  Description of Artificial Sequence: Synthetic oligonucleotide
  Target: ATXN1; (+) strand; PAM type: YTN; PAM sequence: CTG
tgggatattctagttaaatg

SEQ ID NO: 307997 - DNA, 20 bp, Artificial Sequence
  Description of Artificial Sequence: Synthetic oligonucleotide
  Target: ATXN1; (+) strand; PAM type: YTN; PAM sequence: TTC
tagttaaatgaaagctattc

SEQ ID NO: 307998 - DNA, 20 bp, Artificial Sequence
  Description of Artificial Sequence: Synthetic oligonucleotide
  Target: ATXN1; (+) strand; PAM type: YTN; PAM sequence: CTA
gttaaatgaaagctattcaa

SEQ ID NO: 307999 - DNA, 20 bp, Artificial Sequence
  Description of Artificial Sequence: Synthetic oligonucleotide
  Target: ATXN1; (+) strand; PAM type: YTN; PAM sequence: TTA
aatgaaagctattcaacttg

SEQ ID NO: 308000 - DNA, 20 bp, Artificial Sequence
  Description of Artificial Sequence: Synthetic oligonucleotide
  Target: ATXN1; (+) strand; PAM type: YTN; PAM sequence: CTA
ttcaacttgaatcaattgct

SEQ ID NO: 308001 - DNA, 20 bp, Artificial Sequence
  Description of Artificial Sequence: Synthetic oligonucleotide
  Target: ATXN1; (+) strand; PAM type: YTN; PAM sequence: TTC
aacttgaatcaattgctgta

SEQ ID NO: 308002 - DNA, 20 bp, Artificial Sequence
  Description of Artificial Sequence: Synthetic oligonucleotide
  Target: ATXN1; (+) strand; PAM type: YTN; PAM sequence: CTT
gaatcaattgctgtatccat

SEQ ID NO: 308003 - DNA, 20 bp, Artificial Sequence
  Description of Artificial Sequence: Synthetic oligonucleotide
  Target: ATXN1; (+) strand; PAM type: YTN; PAM sequence: TTG
aatcaattgctgtatccatt

SEQ ID NO: 308004 - DNA, 20 bp, Artificial Sequence
  Description of Artificial Sequence: Synthetic oligonucleotide
  Target: ATXN1; (+) strand; PAM type: YTN; PAM sequence: TTG
ctgtatccattctccaatac

SEQ ID NO: 308005 - DNA, 20 bp, Artificial Sequence
  Description of Artificial Sequence: Synthetic oligonucleotide
  Target: ATXN1; (+) strand; PAM type: YTN; PAM sequence: CTG
tatccattctccaatacaca

SEQ ID NO: 308006 - DNA, 20 bp, Artificial Sequence
  Description of Artificial Sequence: Synthetic oligonucleotide
  Target: ATXN1; (+) strand; PAM type: YTN; PAM sequence: TTC
tccaatacacagcagattta

SEQ ID NO: 308007 - DNA, 20 bp, Artificial Sequence
  Description of Artificial Sequence: Synthetic oligonucleotide
  Target: ATXN1; (+) strand; PAM type: YTN; PAM sequence: CTC
caatacacagcagatttata

SEQ ID NO: 308008 - DNA, 20 bp, Artificial Sequence
  Description of Artificial Sequence: Synthetic oligonucleotide
  Target: ATXN1; (+) strand; PAM type: YTN; PAM sequence: TTT
atatttcagaaggtttttga

SEQ ID NO: 308009 - DNA, 20 bp, Artificial Sequence
  Description of Artificial Sequence: Synthetic oligonucleotide
  Target: ATXN1; (+) strand; PAM type: YTN; PAM sequence: TTA
tatttcagaaggtttttgac

SEQ ID NO: 308010 - DNA, 20 bp, Artificial Sequence
  Description of Artificial Sequence: Synthetic oligonucleotide
  Target: ATXN1; (+) strand; PAM type: YTN; PAM sequence: TTT
cagaaggtttttgacagaga

SEQ ID NO: 308011 - DNA, 20 bp, Artificial Sequence
  Description of Artificial Sequence: Synthetic oligonucleotide
  Target: ATXN1; (+) strand; PAM type: YTN; PAM sequence: TTC
agaaggtttttgacagagaa

SEQ ID NO: 308012 - DNA, 20 bp, Artificial Sequence
  Description of Artificial Sequence: Synthetic oligonucleotide
  Target: ATXN1; (+) strand; PAM type: YTN; PAM sequence: TTT
ttgacagagaacaaaatgtt

SEQ ID NO: 308013 - DNA, 20 bp, Artificial Sequence
  Description of Artificial Sequence: Synthetic oligonucleotide
  Target: ATXN1; (+) strand; PAM type: YTN; PAM sequence: TTT
tgacagagaacaaaatgtta

SEQ ID NO: 308014 - DNA, 20 bp, Artificial Sequence
  Description of Artificial Sequence: Synthetic oligonucleotide
  Target: ATXN1; (+) strand; PAM type: YTN; PAM sequence: TTT
gacagagaacaaaatgttac

SEQ ID NO: 308015 - DNA, 20 bp, Artificial Sequence
  Description of Artificial Sequence: Synthetic oligonucleotide
  Target: ATXN1; (+) strand; PAM type: YTN; PAM sequence: TTG
acagagaacaaaatgttact

SEQ ID NO: 308016 - DNA, 20 bp, Artificial Sequence
  Description of Artificial Sequence: Synthetic oligonucleotide
  Target: ATXN1; (+) strand; PAM type: YTN; PAM sequence: TTA
ctgaaatatctcttccattc

SEQ ID NO: 308017 - DNA, 20 bp, Artificial Sequence
  Description of Artificial Sequence: Synthetic oligonucleotide
  Target: ATXN1; (+) strand; PAM type: YTN; PAM sequence: CTG
aaatatctcttccattcctt

SEQ ID NO: 308018 - DNA, 20 bp, Artificial Sequence
  Description of Artificial Sequence: Synthetic oligonucleotide
  Target: ATXN1; (+) strand; PAM type: YTN; PAM sequence: CTC
ttccattccttttgtcctac

SEQ ID NO: 308019 - DNA, 20 bp, Artificial Sequence
  Description of Artificial Sequence: Synthetic oligonucleotide
  Target: ATXN1; (+) strand; PAM type: YTN; PAM sequence: CTT
ccattccttttgtcctacat

SEQ ID NO: 308020 - DNA, 20 bp, Artificial Sequence
  Description of Artificial Sequence: Synthetic oligonucleotide
  Target: ATXN1; (+) strand; PAM type: YTN; PAM sequence: TTC
cattccttttgtcctacata

SEQ ID NO: 308021 - DNA, 20 bp, Artificial Sequence
  Description of Artificial Sequence: Synthetic oligonucleotide
  Target: ATXN1; (+) strand; PAM type: YTN; PAM sequence: TTC
cttttgtcctacataacatt

SEQ ID NO: 308022 - DNA, 20 bp, Artificial Sequence
  Description of Artificial Sequence: Synthetic oligonucleotide
  Target: ATXN1; (+) strand; PAM type: YTN; PAM sequence: CTT
ttgtcctacataacattcca

SEQ ID NO: 308023 - DNA, 20 bp, Artificial Sequence
  Description of Artificial Sequence: Synthetic oligonucleotide
  Target: ATXN1; (+) strand; PAM type: YTN; PAM sequence: TTT
tgtcctacataacattccat

SEQ ID NO: 308024 - DNA, 20 bp, Artificial Sequence
  Description of Artificial Sequence: Synthetic oligonucleotide
  Target: ATXN1; (+) strand; PAM type: YTN; PAM sequence: TTT
gtcctacataacattccatg

SEQ ID NO: 308025 - DNA, 20 bp, Artificial Sequence
  Description of Artificial Sequence: Synthetic oligonucleotide
  Target: ATXN1; (+) strand; PAM type: YTN; PAM sequence: TTG
tcctacataacattccatgg

SEQ ID NO: 308026 - DNA, 20 bp, Artificial Sequence
  Description of Artificial Sequence: Synthetic oligonucleotide
  Target: ATXN1; (+) strand; PAM type: YTN; PAM sequence: CTA
cataacattccatgggctga

SEQ ID NO: 308027 - DNA, 20 bp, Artificial Sequence
  Description of Artificial Sequence: Synthetic oligonucleotide
  Target: ATXN1; (+) strand; PAM type: YTN; PAM sequence: TTC
catgggctgaactcccaacg

SEQ ID NO: 308028 - DNA, 20 bp, Artificial Sequence
  Description of Artificial Sequence: Synthetic oligonucleotide
  Target: ATXN1; (+) strand; PAM type: YTN; PAM sequence: CTG
aactcccaacgaggggcata

SEQ ID NO: 308029 - DNA, 20 bp, Artificial Sequence
  Description of Artificial Sequence: Synthetic oligonucleotide
  Target: ATXN1; (+) strand; PAM type: YTN; PAM sequence: CTC
ccaacgaggggcatatattt

SEQ ID NO: 308030 - DNA, 20 bp, Artificial Sequence
  Description of Artificial Sequence: Synthetic oligonucleotide
  Target: ATXN1; (+) strand; PAM type: YTN; PAM sequence: TTT
gtcagcttctgtttgcactt

SEQ ID NO: 308031 - DNA, 20 bp, Artificial Sequence
  Description of Artificial Sequence: Synthetic oligonucleotide
  Target: ATXN1; (+) strand; PAM type: YTN; PAM sequence: TTG
tcagcttctgtttgcacttg

SEQ ID NO: 308032 - DNA, 20 bp, Artificial Sequence
  Description of Artificial Sequence: Synthetic oligonucleotide
  Target: ATXN1; (+) strand; PAM type: YTN; PAM sequence: CTT
ctgtttgcacttgttctatt

SEQ ID NO: 308033 - DNA, 20 bp, Artificial Sequence
  Description of Artificial Sequence: Synthetic oligonucleotide
  Target: ATXN1; (+) strand; PAM type: YTN; PAM sequence: TTC
tgtttgcacttgttctattg

SEQ ID NO: 308034 - DNA, 20 bp, Artificial Sequence
  Description of Artificial Sequence: Synthetic oligonucleotide
  Target: ATXN1; (+) strand; PAM type: YTN; PAM sequence: CTG
tttgcacttgttctattgta

SEQ ID NO: 308035 - DNA, 20 bp, Artificial Sequence
  Description of Artificial Sequence: Synthetic oligonucleotide
  Target: ATXN1; (+) strand; PAM type: YTN; PAM sequence: TTT
gcacttgttctattgtagtt

SEQ ID NO: 308036 - DNA, 20 bp, Artificial Sequence
  Description of Artificial Sequence: Synthetic oligonucleotide
  Target: ATXN1; (+) strand; PAM type: YTN; PAM sequence: TTG
cacttgttctattgtagttt

SEQ ID NO: 308037 - DNA, 20 bp, Artificial Sequence
  Description of Artificial Sequence: Synthetic oligonucleotide
  Target: ATXN1; (+) strand; PAM type: YTN; PAM sequence: CTT
gttctattgtagtttgtctt

SEQ ID NO: 308038 - DNA, 20 bp, Artificial Sequence
  Description of Artificial Sequence: Synthetic oligonucleotide
  Target: ATXN1; (+) strand; PAM type: YTN; PAM sequence: TTG
ttctattgtagtttgtcttt

SEQ ID NO: 308039 - DNA, 20 bp, Artificial Sequence
  Description of Artificial Sequence: Synthetic oligonucleotide
  Target: ATXN1; (+) strand; PAM type: YTN; PAM sequence: TTC
tattgtagtttgtctttgtt

SEQ ID NO: 308040 - DNA, 20 bp, Artificial Sequence
  Description of Artificial Sequence: Synthetic oligonucleotide
  Target: ATXN1; (+) strand; PAM type: YTN; PAM sequence: CTA
ttgtagtttgtctttgttgc

SEQ ID NO: 308041 - DNA, 20 bp, Artificial Sequence
  Description of Artificial Sequence: Synthetic oligonucleotide
  Target: ATXN1; (+) strand; PAM type: YTN; PAM sequence: TTG
tagtttgtctttgttgcaaa

SEQ ID NO: 308042 - DNA, 20 bp, Artificial Sequence
  Description of Artificial Sequence: Synthetic oligonucleotide
  Target: ATXN1; (+) strand; PAM type: YTN; PAM sequence: TTT
gtctttgttgcaaattttcc

SEQ ID NO: 308043 - DNA, 20 bp, Artificial Sequence
  Description of Artificial Sequence: Synthetic oligonucleotide
  Target: ATXN1; (+) strand; PAM type: YTN; PAM sequence: TTG
tctttgttgcaaattttcca

SEQ ID NO: 308044 - DNA, 20 bp, Artificial Sequence
  Description of Artificial Sequence: Synthetic oligonucleotide
  Target: ATXN1; (+) strand; PAM type: YTN; PAM sequence: CTT
tgttgcaaattttccatttt

SEQ ID NO: 308045 - DNA, 20 bp, Artificial Sequence
  Description of Artificial Sequence: Synthetic oligonucleotide
  Target: ATXN1; (+) strand; PAM type: YTN; PAM sequence: TTT
gttgcaaattttccattttg

SEQ ID NO: 308046 - DNA, 20 bp, Artificial Sequence
  Description of Artificial Sequence: Synthetic oligonucleotide
  Target: ATXN1; (+) strand; PAM type: YTN; PAM sequence: TTG
ttgcaaattttccattttga

SEQ ID NO: 308047 - DNA, 20 bp, Artificial Sequence
  Description of Artificial Sequence: Synthetic oligonucleotide
  Target: ATXN1; (+) strand; PAM type: YTN; PAM sequence: TTG
caaattttccattttgaccc

SEQ ID NO: 308048 - DNA, 20 bp, Artificial Sequence
  Description of Artificial Sequence: Synthetic oligonucleotide
  Target: ATXN1; (+) strand; PAM type: YTN; PAM sequence: TTT
tccattttgaccctttcctg

SEQ ID NO: 308049 - DNA, 20 bp, Artificial Sequence
  Description of Artificial Sequence: Synthetic oligonucleotide
  Target: ATXN1; (+) strand; PAM type: YTN; PAM sequence: TTT
ccattttgaccctttcctga

SEQ ID NO: 308050 - DNA, 20 bp, Artificial Sequence
  Description of Artificial Sequence: Synthetic oligonucleotide
  Target: ATXN1; (+) strand; PAM type: YTN; PAM sequence: TTC
cattttgaccctttcctgac

SEQ ID NO: 308051 - DNA, 20 bp, Artificial Sequence
  Description of Artificial Sequence: Synthetic oligonucleotide
  Target: ATXN1; (+) strand; PAM type: YTN; PAM sequence: TTT
tgaccctttcctgacaaaac

SEQ ID NO: 308052 - DNA, 20 bp, Artificial Sequence
  Description of Artificial Sequence: Synthetic oligonucleotide
  Target: ATXN1; (+) strand; PAM type: YTN; PAM sequence: TTT
gaccctttcctgacaaaaca

SEQ ID NO: 308053 - DNA, 20 bp, Artificial Sequence
  Description of Artificial Sequence: Synthetic oligonucleotide
  Target: ATXN1; (+) strand; PAM type: YTN; PAM sequence: TTG
accctttcctgacaaaacat

SEQ ID NO: 308054 - DNA, 20 bp, Artificial Sequence
  Description of Artificial Sequence: Synthetic oligonucleotide
  Target: ATXN1; (+) strand; PAM type: YTN; PAM sequence: CTT
tcctgacaaaacattaatat

SEQ ID NO: 308055 - DNA, 20 bp, Artificial Sequence
  Description of Artificial Sequence: Synthetic oligonucleotide
  Target: ATXN1; (+) strand; PAM type: YTN; PAM sequence: TTT
cctgacaaaacattaatata

SEQ ID NO: 308056 - DNA, 20 bp, Artificial Sequence
  Description of Artificial Sequence: Synthetic oligonucleotide
  Target: ATXN1; (+) strand; PAM type: YTN; PAM sequence: TTC
ctgacaaaacattaatatat

SEQ ID NO: 308057 - DNA, 20 bp, Artificial Sequence
  Description of Artificial Sequence: Synthetic oligonucleotide
  Target: ATXN1; (+) strand; PAM type: YTN; PAM sequence: CTG
acaaaacattaatatataca

SEQ ID NO: 308058 - DNA, 20 bp, Artificial Sequence
  Description of Artificial Sequence: Synthetic oligonucleotide
  Target: ATXN1; (+) strand; PAM type: YTN; PAM sequence: TTA
atatatacattttggttgtg

SEQ ID NO: 308059 - DNA, 20 bp, Artificial Sequence
  Description of Artificial Sequence: Synthetic oligonucleotide
  Target: ATXN1; (+) strand; PAM type: YTN; PAM sequence: TTT
tggttgtgttacgacttgtt

SEQ ID NO: 308060 - DNA, 20 bp, Artificial Sequence
  Description of Artificial Sequence: Synthetic oligonucleotide
  Target: ATXN1; (+) strand; PAM type: YTN; PAM sequence: TTT
ggttgtgttacgacttgtta

SEQ ID NO: 308061 - DNA, 20 bp, Artificial Sequence
  Description of Artificial Sequence: Synthetic oligonucleotide
  Target: ATXN1; (+) strand; PAM type: YTN; PAM sequence: TTG
gttgtgttacgacttgttaa

SEQ ID NO: 308062 - DNA, 20 bp, Artificial Sequence
  Description of Artificial Sequence: Synthetic oligonucleotide
  Target: ATXN1; (+) strand; PAM type: YTN; PAM sequence: TTG
tgttacgacttgttaaaaaa

SEQ ID NO: 308063 - DNA, 20 bp, Artificial Sequence
  Description of Artificial Sequence: Synthetic oligonucleotide
  Target: ATXN1; (+) strand; PAM type: YTN; PAM sequence: TTA
cgacttgttaaaaaaaaaaa

SEQ ID NO: 308064 - DNA, 20 bp, Artificial Sequence
  Description of Artificial Sequence: Synthetic oligonucleotide
  Target: ATXN1; (+) strand; PAM type: YTN; PAM sequence: CTT
gttaaaaaaaaaaaaaaaaa

SEQ ID NO: 308065 - DNA, 20 bp, Artificial Sequence
  Description of Artificial Sequence: Synthetic oligonucleotide
  Target: ATXN1; (+) strand; PAM type: YTN; PAM sequence: TTG
ttaaaaaaaaaaaaaaaaaa

SEQ ID NO: 308066 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaaaaaaaaaac

SEQ ID NO: 308067 - DNA, 20 bp, Artificial Sequence
  Description of Artificial Sequence: Synthetic oligonucleotide
  Target: ATXN1; (+) strand; PAM type: YTN; PAM sequence: CTG
acatttttattctgtaccac

SEQ ID NO: 308068 - DNA, 20 bp, Artificial Sequence
  Description of Artificial Sequence: Synthetic oligonucleotide
  Target: ATXN1; (+) strand; PAM type: YTN; PAM sequence: TTT
ttattctgtaccaccttgaa

SEQ ID NO: 308069 - DNA, 20 bp, Artificial Sequence
  Description of Artificial Sequence: Synthetic oligonucleotide
  Target: ATXN1; (+) strand; PAM type: YTN; PAM sequence: TTT
tattctgtaccaccttgaag

SEQ ID NO: 308070 - DNA, 20 bp, Artificial Sequence
  Description of Artificial Sequence: Synthetic oligonucleotide
  Target: ATXN1; (+) strand; PAM type: YTN; PAM sequence: TTT
attctgtaccaccttgaagc

SEQ ID NO: 308071 - DNA, 20 bp, Artificial Sequence
  Description of Artificial Sequence: Synthetic oligonucleotide
  Target: ATXN1; (+) strand; PAM type: YTN; PAM sequence: TTA
ttctgtaccaccttgaagca

SEQ ID NO: 308072 - DNA, 20 bp, Artificial Sequence
  Description of Artificial Sequence: Synthetic oligonucleotide
  Target: ATXN1; (+) strand; PAM type: YTN; PAM sequence: TTC
tgtaccaccttgaagcaccc

SEQ ID NO: 308073 - DNA, 20 bp, Artificial Sequence
  Description of Artificial Sequence: Synthetic oligonucleotide
  Target: ATXN1; (+) strand; PAM type: YTN; PAM sequence: CTG
taccaccttgaagcacccat

SEQ ID NO: 308074 - DNA, 20 bp, Artificial Sequence
  Description of Artificial Sequence: Synthetic oligonucleotide
  Target: ATXN1; (+) strand; PAM type: YTN; PAM sequence: CTT
gaagcacccataacttttta

SEQ ID NO: 308075 - DNA, 20 bp, Artificial Sequence
  Description of Artificial Sequence: Synthetic oligonucleotide
  Target: ATXN1; (+) strand; PAM type: YTN; PAM sequence: TTG
aagcacccataactttttaa

SEQ ID NO: 308076 - DNA, 20 bp, Artificial Sequence
  Description of Artificial Sequence: Synthetic oligonucleotide
  Target: ATXN1; (+) strand; PAM type: YTN; PAM sequence: CTT
tttaaaataagccctgctat

SEQ ID NO: 308077 - DNA, 20 bp, Artificial Sequence
  Description of Artificial Sequence: Synthetic oligonucleotide
  Target: ATXN1; (+) strand; PAM type: YTN; PAM sequence: TTT
ttaaaataagccctgctatt

SEQ ID NO: 308078 - DNA, 20 bp, Artificial Sequence
  Description of Artificial Sequence: Synthetic oligonucleotide
  Target: ATXN1; (+) strand; PAM type: YTN; PAM sequence: TTT
taaaataagccctgctattt

SEQ ID NO: 308079 - DNA, 20 bp, Artificial Sequence
  Description of Artificial Sequence: Synthetic oligonucleotide
  Target: ATXN1; (+) strand; PAM type: YTN; PAM sequence: TTT
aaaataagccctgctattta

SEQ ID NO: 308080 - DNA, 20 bp, Artificial Sequence
  Description of Artificial Sequence: Synthetic oligonucleotide
  Target: ATXN1; (+) strand; PAM type: YTN; PAM sequence: TTA
aaataagccctgctatttaa

SEQ ID NO: 308081 - DNA, 20 bp, Artificial Sequence
  Description of Artificial Sequence: Synthetic oligonucleotide
  Target: ATXN1; (+) strand; PAM type: YTN; PAM sequence: CTG
ctatttaaatcagtgatcaa

SEQ ID NO: 308082 - DNA, 20 bp, Artificial Sequence
  Description of Artificial Sequence: Synthetic oligonucleotide
  Target: ATXN1; (+) strand; PAM type: YTN; PAM sequence: CTA
tttaaatcagtgatcaaatt

SEQ ID NO: 308083 - DNA, 20 bp, Artificial Sequence
  Description of Artificial Sequence: Synthetic oligonucleotide
  Target: ATXN1; (+) strand; PAM type: YTN; PAM sequence: TTT
aaatcagtgatcaaattttt

SEQ ID NO: 308084 - DNA, 20 bp, Artificial Sequence
  Description of Artificial Sequence: Synthetic oligonucleotide
  Target: ATXN1; (+) strand; PAM type: YTN; PAM sequence: TTA
aatcagtgatcaaatttttt

SEQ ID NO: 308085 - DNA, 20 bp, Artificial Sequence
  Description of Artificial Sequence: Synthetic oligonucleotide
  Target: ATXN1; (+) strand; PAM type: YTN; PAM sequence: TTT
tttttgtatctgcttatgta

SEQ ID NO: 308086 - DNA, 20 bp, Artificial Sequence
  Description of Artificial Sequence: Synthetic oligonucleotide
  Target: ATXN1; (+) strand; PAM type: YTN; PAM sequence: TTT
ttttgtatctgcttatgtaa

SEQ ID NO: 308087 - DNA, 20 bp, Artificial Sequence
  Description of Artificial Sequence: Synthetic oligonucleotide
  Target: ATXN1; (+) strand; PAM type: YTN; PAM sequence: TTT
tttgtatctgcttatgtaaa

SEQ ID NO: 308088 - DNA, 20 bp, Artificial Sequence
  Description of Artificial Sequence: Synthetic oligonucleotide
  Target: ATXN1; (+) strand; PAM type: YTN; PAM sequence: TTT
ttgtatctgcttatgtaaac

SEQ ID NO: 308089 - DNA, 20 bp, Artificial Sequence
  Description of Artificial Sequence: Synthetic oligonucleotide
  Target: ATXN1; (+) strand; PAM type: YTN; PAM sequence: TTT
tgtatctgcttatgtaaaca

SEQ ID NO: 308090 - DNA, 20 bp, Artificial Sequence
  Description of Artificial Sequence: Synthetic oligonucleotide
  Target: ATXN1; (+) strand; PAM type: YTN; PAM sequence: TTT
gtatctgcttatgtaaacac

SEQ ID NO: 308091 - DNA, 20 bp, Artificial Sequence
  Description of Artificial Sequence: Synthetic oligonucleotide
  Target: ATXN1; (+) strand; PAM type: YTN; PAM sequence: TTG
tatctgcttatgtaaacact

SEQ ID NO: 308092 - DNA, 20 bp, Artificial Sequence
  Description of Artificial Sequence: Synthetic oligonucleotide
  Target: ATXN1; (+) strand; PAM type: YTN; PAM sequence: CTG
cttatgtaaacactagaaat

SEQ ID NO: 308093 - DNA, 20 bp, Artificial Sequence
  Description of Artificial Sequence: Synthetic oligonucleotide
  Target: ATXN1; (+) strand; PAM type: YTN; PAM sequence: CTT
atgtaaacactagaaatcca

SEQ ID NO: 308094 - DNA, 20 bp, Artificial Sequence
  Description of Artificial Sequence: Synthetic oligonucleotide
  Target: ATXN1; (+) strand; PAM type: YTN; PAM sequence: TTA
tgtaaacactagaaatccag

SEQ ID NO: 308095 - DNA, 20 bp, Artificial Sequence
  Description of Artificial Sequence: Synthetic oligonucleotide
  Target: ATXN1; (+) strand; PAM type: YTN; PAM sequence: CTA
gaaatccagggagaaaattc

SEQ ID NO: 308096 - DNA, 20 bp, Artificial Sequence
  Description of Artificial Sequence: Synthetic oligonucleotide
  Target: ATXN1; (+) strand; PAM type: YTN; PAM sequence: TTC
ttccaatccaacaatccaca

SEQ ID NO: 308097 - DNA, 20 bp, Artificial Sequence
  Description of Artificial Sequence: Synthetic oligonucleotide
  Target: ATXN1; (+) strand; PAM type: YTN; PAM sequence: CTT
ccaatccaacaatccacaca

SEQ ID NO: 308098 - DNA, 20 bp, Artificial Sequence
  Description of Artificial Sequence: Synthetic oligonucleotide
  Target: ATXN1; (+) strand; PAM type: YTN; PAM sequence: TTC
caatccaacaatccacacat

SEQ ID NO: 308099 - DNA, 20 bp, Artificial Sequence
  Description of Artificial Sequence: Synthetic oligonucleotide
  Target: ATXN1; (+) strand; PAM type: YTN; PAM sequence: TTC
ctacacaaaaccaatcactt

SEQ ID NO: 308100 - DNA, 20 bp, Artificial Sequence
  Description of Artificial Sequence: Synthetic oligonucleotide
  Target: ATXN1; (+) strand; PAM type: YTN; PAM sequence: CTA
cacaaaaccaatcacttgag

SEQ ID NO: 308101 - DNA, 20 bp, Artificial Sequence
  Description of Artificial Sequence: Synthetic oligonucleotide
  Target: ATXN1; (+) strand; PAM type: YTN; PAM sequence: CTT
gagtatttaaaagctagatc

SEQ ID NO: 308102 - DNA, 20 bp, Artificial Sequence
  Description of Artificial Sequence: Synthetic oligonucleotide
  Target: ATXN1; (+) strand; PAM type: YTN; PAM sequence: TTG
agtatttaaaagctagatct

SEQ ID NO: 308103 - DNA, 20 bp, Artificial Sequence
  Description of Artificial Sequence: Synthetic oligonucleotide
  Target: ATXN1; (+) strand; PAM type: YTN; PAM sequence: TTT
aaaagctagatctgtggcga

SEQ ID NO: 308104 - DNA, 20 bp, Artificial Sequence
  Description of Artificial Sequence: Synthetic oligonucleotide
  Target: ATXN1; (+) strand; PAM type: YTN; PAM sequence: TTA
aaagctagatctgtggcgag

SEQ ID NO: 308105 - DNA, 20 bp, Artificial Sequence
  Description of Artificial Sequence: Synthetic oligonucleotide
  Target: ATXN1; (+) strand; PAM type: YTN; PAM sequence: CTA
gatctgtggcgagagacagg

SEQ ID NO: 308106 - DNA, 20 bp, Artificial Sequence
  Description of Artificial Sequence: Synthetic oligonucleotide
  Target: ATXN1; (+) strand; PAM type: YTN; PAM sequence: CTG
tggcgagagacaggctagaa

SEQ ID NO: 308107 - DNA, 20 bp, Artificial Sequence
  Description of Artificial Sequence: Synthetic oligonucleotide
  Target: ATXN1; (+) strand; PAM type: YTN; PAM sequence: CTA
gaactagcacaaacaagtct

SEQ ID NO: 308108 - DNA, 20 bp, Artificial Sequence
  Description of Artificial Sequence: Synthetic oligonucleotide
  Target: ATXN1; (+) strand; PAM type: YTN; PAM sequence: CTA
gcacaaacaagtctgtgcaa

SEQ ID NO: 308109 - DNA, 20 bp, Artificial Sequence
  Description of Artificial Sequence: Synthetic oligonucleotide
  Target: ATXN1; (+) strand; PAM type: YTN; PAM sequence: CTG
tgcaagatgaatttatcctc

SEQ ID NO: 308110 - DNA, 20 bp, Artificial Sequence
  Description of Artificial Sequence: Synthetic oligonucleotide
  Target: ATXN1; (+) strand; PAM type: YTN; PAM sequence: TTT
atcctccactgcctctactc

SEQ ID NO: 308111 - DNA, 20 bp, Artificial Sequence
  Description of Artificial Sequence: Synthetic oligonucleotide
  Target: ATXN1; (+) strand; PAM type: YTN; PAM sequence: TTA
tcctccactgcctctactcc

SEQ ID NO: 308112 - DNA, 20 bp, Artificial Sequence
  Description of Artificial Sequence: Synthetic oligonucleotide
  Target: ATXN1; (+) strand; PAM type: YTN; PAM sequence: CTC
cactgcctctactccaggtc

SEQ ID NO: 308113 - DNA, 20 bp, Artificial Sequence
  Description of Artificial Sequence: Synthetic oligonucleotide
  Target: ATXN1; (+) strand; PAM type: YTN; PAM sequence: CTG
cctctactccaggtcatccc

SEQ ID NO: 308114 - DNA, 20 bp, Artificial Sequence
  Description of Artificial Sequence: Synthetic oligonucleotide
  Target: ATXN1; (+) strand; PAM type: YTN; PAM sequence: CTC
tactccaggtcatcccagga

SEQ ID NO: 308115 - DNA, 20 bp, Artificial Sequence
  Description of Artificial Sequence: Synthetic oligonucleotide
  Target: ATXN1; (+) strand; PAM type: YTN; PAM sequence: CTA
ctccaggtcatcccaggact

SEQ ID NO: 308116 - DNA, 20 bp, Artificial Sequence
  Description of Artificial Sequence: Synthetic oligonucleotide
  Target: ATXN1; (+) strand; PAM type: YTN; PAM sequence: CTC
caggtcatcccaggactatg

SEQ ID NO: 308117 - DNA, 20 bp, Artificial Sequence
  Description of Artificial Sequence: Synthetic oligonucleotide
  Target: ATXN1; (+) strand; PAM type: YTN; PAM sequence: CTA
tgcctgtgagctaatgccaa

SEQ ID NO: 308118 - DNA, 20 bp, Artificial Sequence
  Description of Artificial Sequence: Synthetic oligonucleotide
  Target: ATXN1; (+) strand; PAM type: YTN; PAM sequence: CTG
tgagctaatgccaagatgga

SEQ ID NO: 308119 - DNA, 20 bp, Artificial Sequence
  Description of Artificial Sequence: Synthetic oligonucleotide
  Target: ATXN1; (+) strand; PAM type: YTN; PAM sequence: CTA
atgccaagatggaaaaaaaa

SEQ ID NO: 308120 - DNA, 20 bp, Artificial Sequence
  Description of Artificial Sequence: Synthetic oligonucleotide
  Target: ATXN1; (+) strand; PAM type: YTN; PAM sequence: CTT
ttttctagtgtatttgtgta

SEQ ID NO: 308121 - DNA, 20 bp, Artificial Sequence
  Description of Artificial Sequence: Synthetic oligonucleotide
  Target: ATXN1; (+) strand; PAM type: YTN; PAM sequence: TTT
tttctagtgtatttgtgtaa

SEQ ID NO: 308122 - DNA, 20 bp, Artificial Sequence
  Description of Artificial Sequence: Synthetic oligonucleotide
  Target: ATXN1; (+) strand; PAM type: YTN; PAM sequence: TTT
ttctagtgtatttgtgtaaa

SEQ ID NO: 308123 - DNA, 20 bp, Artificial Sequence
  Description of Artificial Sequence: Synthetic oligonucleotide
  Target: ATXN1; (+) strand; PAM type: YTN; PAM sequence: TTT
tctagtgtatttgtgtaaag

SEQ ID NO: 308124 - DNA, 20 bp, Artificial Sequence
  Description of Artificial Sequence: Synthetic oligonucleotide
  Target: ATXN1; (+) strand; PAM type: YTN; PAM sequence: TTT
ctagtgtatttgtgtaaaga

SEQ ID NO: 308125 - DNA, 20 bp, Artificial Sequence
  Description of Artificial Sequence: Synthetic oligonucleotide
  Target: ATXN1; (+) strand; PAM type: YTN; PAM sequence: TTC
tagtgtatttgtgtaaagac

SEQ ID NO: 308126 - DNA, 20 bp, Artificial Sequence
  Description of Artificial Sequence: Synthetic oligonucleotide
  Target: ATXN1; (+) strand; PAM type: YTN; PAM sequence: CTA
gtgtatttgtgtaaagactc

SEQ ID NO: 308127 - DNA, 20 bp, Artificial Sequence
  Description of Artificial Sequence: Synthetic oligonucleotide
  Target: ATXN1; (+) strand; PAM type: YTN; PAM sequence: TTT
gtgtaaagactccccaagag

SEQ ID NO: 308128 - DNA, 20 bp, Artificial Sequence
  Description of Artificial Sequence: Synthetic oligonucleotide
  Target: ATXN1; (+) strand; PAM type: YTN; PAM sequence: TTG
tgtaaagactccccaagagc

SEQ ID NO: 308129 - DNA, 20 bp, Artificial Sequence
  Description of Artificial Sequence: Synthetic oligonucleotide
  Target: ATXN1; (+) strand; PAM type: YTN; PAM sequence: CTC
cccaagagctcaagagggag

SEQ ID NO: 308130 - DNA, 20 bp, Artificial Sequence
  Description of Artificial Sequence: Synthetic oligonucleotide
  Target: ATXN1; (+) strand; PAM type: YTN; PAM sequence: CTC
aagagggagttgctgctctg

SEQ ID NO: 308131 - DNA, 20 bp, Artificial Sequence
  Description of Artificial Sequence: Synthetic oligonucleotide
  Target: ATXN1; (+) strand; PAM type: YTN; PAM sequence: TTG
ctgctctgcaaatgacaaaa

SEQ ID NO: 308132 - DNA, 20 bp, Artificial Sequence
  Description of Artificial Sequence: Synthetic oligonucleotide
  Target: ATXN1; (+) strand; PAM type: YTN; PAM sequence: CTG
ctctgcaaatgacaaaaggt

SEQ ID NO: 308133 - DNA, 20 bp, Artificial Sequence
  Description of Artificial Sequence: Synthetic oligonucleotide
  Target: ATXN1; (+) strand; PAM type: YTN; PAM sequence: CTC
tgcaaatgacaaaaggtgtg

SEQ ID NO: 308134 - DNA, 20 bp, Artificial Sequence
  Description of Artificial Sequence: Synthetic oligonucleotide
  Target: ATXN1; (+) strand; PAM type: YTN; PAM sequence: CTG
caaatgacaaaaggtgtgta

SEQ ID NO: 308135 - DNA, 20 bp, Artificial Sequence
  Description of Artificial Sequence: Synthetic oligonucleotide
  Target: ATXN1; (+) strand; PAM type: YTN; PAM sequence: CTG
caagccaatcaggcagaaca

SEQ ID NO: 308136 - DNA, 20 bp, Artificial Sequence
  Description of Artificial Sequence: Synthetic oligonucleotide
  Target: ATXN1; (+) strand; PAM type: YTN; PAM sequence: TTT
aacatcgtcctggccattaa

SEQ ID NO: 308137 - DNA, 20 bp, Artificial Sequence
  Description of Artificial Sequence: Synthetic oligonucleotide
  Target: ATXN1; (+) strand; PAM type: YTN; PAM sequence: TTA
acatcgtcctggccattaat

SEQ ID NO: 308138 - DNA, 20 bp, Artificial Sequence
  Description of Artificial Sequence: Synthetic oligonucleotide
  Target: ATXN1; (+) strand; PAM type: YTN; PAM sequence: CTG
gccattaatgactaagcctg

SEQ ID NO: 308139 - DNA, 20 bp, Artificial Sequence
  Description of Artificial Sequence: Synthetic oligonucleotide
  Target: ATXN1; (+) strand; PAM type: YTN; PAM sequence: TTA
atgactaagcctgcgccagc

SEQ ID NO: 308140 - DNA, 20 bp, Artificial Sequence
  Description of Artificial Sequence: Synthetic oligonucleotide
  Target: ATXN1; (+) strand; PAM type: YTN; PAM sequence: CTA
agcctgcgccagctcaaaag

SEQ ID NO: 308141 - DNA, 20 bp, Artificial Sequence
  Description of Artificial Sequence: Synthetic oligonucleotide
  Target: ATXN1; (+) strand; PAM type: YTN; PAM sequence: CTG
cgccagctcaaaagcggtcg

SEQ ID NO: 308142 - DNA, 20 bp, Artificial Sequence
  Description of Artificial Sequence: Synthetic oligonucleotide
  Target: ATXN1; (+) strand; PAM type: YTN; PAM sequence: CTC
aaaagcggtcggaaacagac

SEQ ID NO: 308143 - DNA, 20 bp, Artificial Sequence
  Description of Artificial Sequence: Synthetic oligonucleotide
  Target: ATXN1; (+) strand; PAM type: YTN; PAM sequence: CTA
tgggacagctaaaacattga

SEQ ID NO: 308144 - DNA, 20 bp, Artificial Sequence
  Description of Artificial Sequence: Synthetic oligonucleotide
  Target: ATXN1; (+) strand; PAM type: YTN; PAM sequence: CTA
aaacattgattctcagggat

SEQ ID NO: 308145 - DNA, 20 bp, Artificial Sequence
  Description of Artificial Sequence: Synthetic oligonucleotide
  Target: ATXN1; (+) strand; PAM type: YTN; PAM sequence: TTG
attctcagggatgtcgtcca

SEQ ID NO: 308146 - DNA, 20 bp, Artificial Sequence
  Description of Artificial Sequence: Synthetic oligonucleotide
  Target: ATXN1; (+) strand; PAM type: YTN; PAM sequence: TTC
tcagggatgtcgtccaagag

SEQ ID NO: 308147 - DNA, 20 bp, Artificial Sequence
  Description of Artificial Sequence: Synthetic oligonucleotide
  Target: ATXN1; (+) strand; PAM type: YTN; PAM sequence: CTC
agggatgtcgtccaagagga

SEQ ID NO: 308148 - DNA, 20 bp, Artificial Sequence
  Description of Artificial Sequence: Synthetic oligonucleotide
  Target: ATXN1; (+) strand; PAM type: YTN; PAM sequence: CTC
tgaagctgggtgtcatcctt

SEQ ID NO: 308149 - DNA, 20 bp, Artificial Sequence
  Description of Artificial Sequence: Synthetic oligonucleotide
  Target: ATXN1; (+) strand; PAM type: YTN; PAM sequence: CTG
aagctgggtgtcatccttta

SEQ ID NO: 308150 - DNA, 20 bp, Artificial Sequence
  Description of Artificial Sequence: Synthetic oligonucleotide
  Target: ATXN1; (+) strand; PAM type: YTN; PAM sequence: CTG
ggtgtcatcctttagggtgg

SEQ ID NO: 308151 - DNA, 20 bp, Artificial Sequence
  Description of Artificial Sequence: Synthetic oligonucleotide
  Target: ATXN1; (+) strand; PAM type: YTN; PAM sequence: CTT
tagggtggcccagaataaaa

SEQ ID NO: 308152 - DNA, 20 bp, Artificial Sequence
  Description of Artificial Sequence: Synthetic oligonucleotide
  Target: ATXN1; (+) strand; PAM type: YTN; PAM sequence: TTT
agggtggcccagaataaaat

SEQ ID NO: 308153 - DNA, 20 bp, Artificial Sequence
  Description of Artificial Sequence: Synthetic oligonucleotide
  Target: ATXN1; (+) strand; PAM type: YTN; PAM sequence: TTA
gggtggcccagaataaaatg

SEQ ID NO: 308154 - DNA, 20 bp, Artificial Sequence
  Description of Artificial Sequence: Synthetic oligonucleotide
  Target: ATXN1; (+) strand; PAM type: YTN; PAM sequence: TTA
tgcctcctggcgagttcata

SEQ ID NO: 308155 - DNA, 20 bp, Artificial Sequence
  Description of Artificial Sequence: Synthetic oligonucleotide
  Target: ATXN1; (+) strand; PAM type: YTN; PAM sequence: CTC
ctggcgagttcataaacact

SEQ ID NO: 308156 - DNA, 20 bp, Artificial Sequence
  Description of Artificial Sequence: Synthetic oligonucleotide
  Target: ATXN1; (+) strand; PAM type: YTN; PAM sequence: CTG
gcgagttcataaacactttg

SEQ ID NO: 308157 - DNA, 20 bp, Artificial Sequence
  Description of Artificial Sequence: Synthetic oligonucleotide
  Target: ATXN1; (+) strand; PAM type: YTN; PAM sequence: TTC
ataaacactttgaacggcaa

SEQ ID NO: 308158 - DNA, 20 bp, Artificial Sequence
  Description of Artificial Sequence: Synthetic oligonucleotide
  Target: ATXN1; (+) strand; PAM type: YTN; PAM sequence: CTT
tgaacggcaaagacaccaag

SEQ ID NO: 308159 - DNA, 20 bp, Artificial Sequence
  Description of Artificial Sequence: Synthetic oligonucleotide
  Target: ATXN1; (+) strand; PAM type: YTN; PAM sequence: TTT
gaacggcaaagacaccaagt

SEQ ID NO: 308160 - DNA, 20 bp, Artificial Sequence
  Description of Artificial Sequence: Synthetic oligonucleotide
  Target: ATXN1; (+) strand; PAM type: YTN; PAM sequence: TTG
aacggcaaagacaccaagtc

SEQ ID NO: 308161 - DNA, 20 bp, Artificial Sequence
  Description of Artificial Sequence: Synthetic oligonucleotide
  Target: ATXN1; (+) strand; PAM type: YTN; PAM sequence: CTT
ccaacgaagatcttggggca

SEQ ID NO: 308162 - DNA, 20 bp, Artificial Sequence
  Description of Artificial Sequence: Synthetic oligonucleotide
  Target: ATXN1; (+) strand; PAM type: YTN; PAM sequence: TTC
caacgaagatcttggggcaa

SEQ ID NO: 308163 - DNA, 20 bp, Artificial Sequence
  Description of Artificial Sequence: Synthetic oligonucleotide
  Target: ATXN1; (+) strand; PAM type: YTN; PAM sequence: CTT
ggggcaagaagagatgtcca

SEQ ID NO: 308164 - DNA, 20 bp, Artificial Sequence
  Description of Artificial Sequence: Synthetic oligonucleotide
  Target: ATXN1; (+) strand; PAM type: YTN; PAM sequence: TTG
gggcaagaagagatgtccac

SEQ ID NO: 308165 - DNA, 20 bp, Artificial Sequence
  Description of Artificial Sequence: Synthetic oligonucleotide
  Target: ATXN1; (+) strand; PAM type: YTN; PAM sequence: CTT
tctgttctgtgacctgttag

SEQ ID NO: 308166 - DNA, 20 bp, Artificial Sequence
  Description of Artificial Sequence: Synthetic oligonucleotide
  Target: ATXN1; (+) strand; PAM type: YTN; PAM sequence: TTT
ctgttctgtgacctgttaga

SEQ ID NO: 308167 - DNA, 20 bp, Artificial Sequence
  Description of Artificial Sequence: Synthetic oligonucleotide
  Target: ATXN1; (+) strand; PAM type: YTN; PAM sequence: TTC
tgttctgtgacctgttagag

SEQ ID NO: 308168 - DNA, 20 bp, Artificial Sequence
  Description of Artificial Sequence: Synthetic oligonucleotide
  Target: ATXN1; (+) strand; PAM type: YTN; PAM sequence: CTG
ttctgtgacctgttagagag

SEQ ID NO: 308169 - DNA, 20 bp, Artificial Sequence
  Description of Artificial Sequence: Synthetic oligonucleotide
  Target: ATXN1; (+) strand; PAM type: YTN; PAM sequence: TTC
tgtgacctgttagagagaaa

SEQ ID NO: 308170 - DNA, 20 bp, Artificial Sequence
  Description of Artificial Sequence: Synthetic oligonucleotide
  Target: ATXN1; (+) strand; PAM type: YTN; PAM sequence: CTG
tgacctgttagagagaaaca

SEQ ID NO: 308171 - DNA, 20 bp, Artificial Sequence
  Description of Artificial Sequence: Synthetic oligonucleotide
  Target: ATXN1; (+) strand; PAM type: YTN; PAM sequence: CTG
ttagagagaaacattcttag

SEQ ID NO: 308172 - DNA, 20 bp, Artificial Sequence
  Description of Artificial Sequence: Synthetic oligonucleotide
  Target: ATXN1; (+) strand; PAM type: YTN; PAM sequence: TTA
gagagaaacattcttagcta

SEQ ID NO: 308173 - DNA, 20 bp, Artificial Sequence
  Description of Artificial Sequence: Synthetic oligonucleotide
  Target: ATXN1; (+) strand; PAM type: YTN; PAM sequence: TTC
ttagctactccatcaccaag

SEQ ID NO: 308174 - DNA, 20 bp, Artificial Sequence
  Description of Artificial Sequence: Synthetic oligonucleotide
  Target: ATXN1; (+) strand; PAM type: YTN; PAM sequence: CTT
agctactccatcaccaagca

SEQ ID NO: 308175 - DNA, 20 bp, Artificial Sequence
  Description of Artificial Sequence: Synthetic oligonucleotide
  Target: ATXN1; (+) strand; PAM type: YTN; PAM sequence: TTA
gctactccatcaccaagcaa

SEQ ID NO: 308176 - DNA, 20 bp, Artificial Sequence
  Description of Artificial Sequence: Synthetic oligonucleotide
  Target: ATXN1; (+) strand; PAM type: YTN; PAM sequence: CTA
ctccatcaccaagcaaaagt

SEQ ID NO: 308177 - DNA, 20 bp, Artificial Sequence
  Description of Artificial Sequence: Synthetic oligonucleotide
  Target: ATXN1; (+) strand; PAM type: YTN; PAM sequence: CTC
catcaccaagcaaaagtccc

SEQ ID NO: 308178 - DNA, 20 bp, Artificial Sequence
  Description of Artificial Sequence: Synthetic oligonucleotide
  Target: ATXN1; (+) strand; PAM type: YTN; PAM sequence: CTG
ccaggctgtatctccttgac

SEQ ID NO: 308179 - DNA, 20 bp, Artificial Sequence
  Description of Artificial Sequence: Synthetic oligonucleotide
  Target: ATXN1; (+) strand; PAM type: YTN; PAM sequence: CTG
tatctccttgactcctgggg

SEQ ID NO: 308180 - DNA, 20 bp, Artificial Sequence
  Description of Artificial Sequence: Synthetic oligonucleotide
  Target: ATXN1; (+) strand; PAM type: YTN; PAM sequence: CTC
cttgactcctgggggaaaag

SEQ ID NO: 308181 - DNA, 20 bp, Artificial Sequence
  Description of Artificial Sequence: Synthetic oligonucleotide
  Target: ATXN1; (+) strand; PAM type: YTN; PAM sequence: CTT
gactcctgggggaaaagctg

SEQ ID NO: 308182 - DNA, 20 bp, Artificial Sequence
  Description of Artificial Sequence: Synthetic oligonucleotide
  Target: ATXN1; (+) strand; PAM type: YTN; PAM sequence: TTG
actcctgggggaaaagctgt

SEQ ID NO: 308183 - DNA, 20 bp, Artificial Sequence
  Description of Artificial Sequence: Synthetic oligonucleotide
  Target: ATXN1; (+) strand; PAM type: YTN; PAM sequence: CTC
ctgggggaaaagctgtaaag

SEQ ID NO: 308184 - DNA, 20 bp, Artificial Sequence
  Description of Artificial Sequence: Synthetic oligonucleotide
  Target: ATXN1; (+) strand; PAM type: YTN; PAM sequence: CTG
ggggaaaagctgtaaagaga

SEQ ID NO: 308185 - DNA, 20 bp, Artificial Sequence
  Description of Artificial Sequence: Synthetic oligonucleotide
  Target: ATXN1; (+) strand; PAM type: YTN; PAM sequence: CTG
taaagagattgaggagggca

SEQ ID NO: 308186 - DNA, 20 bp, Artificial Sequence
  Description of Artificial Sequence: Synthetic oligonucleotide
  Target: ATXN1; (+) strand; PAM type: YTN; PAM sequence: TTG
aggagggcacctaagagaga

SEQ ID NO: 308187 - DNA, 20 bp, Artificial Sequence
  Description of Artificial Sequence: Synthetic oligonucleotide
  Target: ATXN1; (+) strand; PAM type: YTN; PAM sequence: CTA
agagagagatagatggcctt

SEQ ID NO: 308188 - DNA, 20 bp, Artificial Sequence
  Description of Artificial Sequence: Synthetic oligonucleotide
  Target: ATXN1; (+) strand; PAM type: YTN; PAM sequence: CTT
tgtcttgtttgcagtttcac

SEQ ID NO: 308189 - DNA, 20 bp, Artificial Sequence
  Description of Artificial Sequence: Synthetic oligonucleotide
  Target: ATXN1; (+) strand; PAM type: YTN; PAM sequence: TTT
gtcttgtttgcagtttcact

SEQ ID NO: 308190 - DNA, 20 bp, Artificial Sequence
  Description of Artificial Sequence: Synthetic oligonucleotide
  Target: ATXN1; (+) strand; PAM type: YTN; PAM sequence: TTG
tcttgtttgcagtttcacta

SEQ ID NO: 308191 - DNA, 20 bp, Artificial Sequence
  Description of Artificial Sequence: Synthetic oligonucleotide
  Target: ATXN1; (+) strand; PAM type: YTN; PAM sequence: CTT
gtttgcagtttcactaatga

SEQ ID NO: 308192 - DNA, 20 bp, Artificial Sequence
  Description of Artificial Sequence: Synthetic oligonucleotide
  Target: ATXN1; (+) strand; PAM type: YTN; PAM sequence: TTG
tttgcagtttcactaatgag

SEQ ID NO: 308193 - DNA, 20 bp, Artificial Sequence
  Description of Artificial Sequence: Synthetic oligonucleotide
  Target: ATXN1; (+) strand; PAM type: YTN; PAM sequence: TTT
gcagtttcactaatgaggtt

SEQ ID NO: 308194 - DNA, 20 bp, Artificial Sequence
  Description of Artificial Sequence: Synthetic oligonucleotide
  Target: ATXN1; (+) strand; PAM type: YTN; PAM sequence: TTG
cagtttcactaatgaggttt

SEQ ID NO: 308195 - DNA, 20 bp, Artificial Sequence
  Description of Artificial Sequence: Synthetic oligonucleotide
  Target: ATXN1; (+) strand; PAM type: YTN; PAM sequence: TTT
cactaatgaggtttccagat

SEQ ID NO: 308196 - DNA, 20 bp, Artificial Sequence
  Description of Artificial Sequence: Synthetic oligonucleotide
  Target: ATXN1; (+) strand; PAM type: YTN; PAM sequence: TTC
actaatgaggtttccagata

SEQ ID NO: 308197 - DNA, 20 bp, Artificial Sequence
  Description of Artificial Sequence: Synthetic oligonucleotide
  Target: ATXN1; (+) strand; PAM type: YTN; PAM sequence: CTA
atgaggtttccagatataaa

SEQ ID NO: 308198 - DNA, 20 bp, Artificial Sequence
  Description of Artificial Sequence: Synthetic oligonucleotide
  Target: ATXN1; (+) strand; PAM type: YTN; PAM sequence: TTT
ccagatataaaatctggctt

SEQ ID NO: 308199 - DNA, 20 bp, Artificial Sequence
  Description of Artificial Sequence: Synthetic oligonucleotide
  Target: ATXN1; (+) strand; PAM type: YTN; PAM sequence: TTC
cagatataaaatctggcttc

SEQ ID NO: 308200 - DNA, 20 bp, Artificial Sequence
  Description of Artificial Sequence: Synthetic oligonucleotide
  Target: ATXN1; (+) strand; PAM type: YTN; PAM sequence: CTG
gcttctgtcaagtctaaatg

SEQ ID NO: 308201 - DNA, 20 bp, Artificial Sequence
  Description of Artificial Sequence: Synthetic oligonucleotide
  Target: ATXN1; (+) strand; PAM type: YTN; PAM sequence: CTT
ctgtcaagtctaaatgtgaa

SEQ ID NO: 308202 - DNA, 20 bp, Artificial Sequence
  Description of Artificial Sequence: Synthetic oligonucleotide
  Target: ATXN1; (+) strand; PAM type: YTN; PAM sequence: TTC
tgtcaagtctaaatgtgaat

SEQ ID NO: 308203 - DNA, 20 bp, Artificial Sequence
  Description of Artificial Sequence: Synthetic oligonucleotide
  Target: ATXN1; (+) strand; PAM type: YTN; PAM sequence: CTG
tcaagtctaaatgtgaatca

SEQ ID NO: 308204 - DNA, 20 bp, Artificial Sequence
  Description of Artificial Sequence: Synthetic oligonucleotide
  Target: ATXN1; (+) strand; PAM type: YTN; PAM sequence: CTA
aatgtgaatcagattctgag

SEQ ID NO: 308205 - DNA, 20 bp, Artificial Sequence
  Description of Artificial Sequence: Synthetic oligonucleotide
  Target: ATXN1; (+) strand; PAM type: YTN; PAM sequence: TTC
tgagtatttctgcaactaac

SEQ ID NO: 308206 - DNA, 20 bp, Artificial Sequence
  Description of Artificial Sequence: Synthetic oligonucleotide
  Target: ATXN1; (+) strand; PAM type: YTN; PAM sequence: CTG
agtatttctgcaactaacaa

SEQ ID NO: 308207 - DNA, 20 bp, Artificial Sequence
  Description of Artificial Sequence: Synthetic oligonucleotide
  Target: ATXN1; (+) strand; PAM type: YTN; PAM sequence: TTT
ctgcaactaacaatatggtc

SEQ ID NO: 308208 - DNA, 20 bp, Artificial Sequence
  Description of Artificial Sequence: Synthetic oligonucleotide
  Target: ATXN1; (+) strand; PAM type: YTN; PAM sequence: TTC
tgcaactaacaatatggtca

SEQ ID NO: 308209 - DNA, 20 bp, Artificial Sequence
  Description of Artificial Sequence: Synthetic oligonucleotide
  Target: ATXN1; (+) strand; PAM type: YTN; PAM sequence: CTG
caactaacaatatggtcacc

SEQ ID NO: 308210 - DNA, 20 bp, Artificial Sequence
  Description of Artificial Sequence: Synthetic oligonucleotide
  Target: ATXN1; (+) strand; PAM type: YTN; PAM sequence: CTA
acaatatggtcaccagcaaa

SEQ ID NO: 308211 - DNA, 20 bp, Artificial Sequence
  Description of Artificial Sequence: Synthetic oligonucleotide
  Target: ATXN1; (+) strand; PAM type: YTN; PAM sequence: CTA
cttctgcaaagaaagaaaag

SEQ ID NO: 308212 - DNA, 20 bp, Artificial Sequence
  Description of Artificial Sequence: Synthetic oligonucleotide
  Target: ATXN1; (+) strand; PAM type: YTN; PAM sequence: CTT
ctgcaaagaaagaaaaggct

SEQ ID NO: 308213 - DNA, 20 bp, Artificial Sequence
  Description of Artificial Sequence: Synthetic oligonucleotide
  Target: ATXN1; (+) strand; PAM type: YTN; PAM sequence: TTC
tgcaaagaaagaaaaggctt

SEQ ID NO: 308214 - DNA, 20 bp, Artificial Sequence
  Description of Artificial Sequence: Synthetic oligonucleotide
  Target: ATXN1; (+) strand; PAM type: YTN; PAM sequence: CTG
caaagaaagaaaaggcttca

SEQ ID NO: 308215 - DNA, 20 bp, Artificial Sequence
  Description of Artificial Sequence: Synthetic oligonucleotide
  Target: ATXN1; (+) strand; PAM type: YTN; PAM sequence: CTT
cataatagttattgcttctg

SEQ ID NO: 308216 - DNA, 20 bp, Artificial Sequence
  Description of Artificial Sequence: Synthetic oligonucleotide
  Target: ATXN1; (+) strand; PAM type: YTN; PAM sequence: TTC
ataatagttattgcttctgg

SEQ ID NO: 308217 - DNA, 20 bp, Artificial Sequence
  Description of Artificial Sequence: Synthetic oligonucleotide
  Target: ATXN1; (+) strand; PAM type: YTN; PAM sequence: TTA
ttgcttctggcaccaagaga

SEQ ID NO: 308218 - DNA, 20 bp, Artificial Sequence
  Description of Artificial Sequence: Synthetic oligonucleotide
  Target: ATXN1; (+) strand; PAM type: YTN; PAM sequence: TTG
cttctggcaccaagagatgg

SEQ ID NO: 308219 - DNA, 20 bp, Artificial Sequence
  Description of Artificial Sequence: Synthetic oligonucleotide
  Target: ATXN1; (+) strand; PAM type: YTN; PAM sequence: CTT
ctggcaccaagagatggaca

SEQ ID NO: 308220 - DNA, 20 bp, Artificial Sequence
  Description of Artificial Sequence: Synthetic oligonucleotide
  Target: ATXN1; (+) strand; PAM type: YTN; PAM sequence: TTC
tggcaccaagagatggacag

SEQ ID NO: 308221 - DNA, 20 bp, Artificial Sequence
  Description of Artificial Sequence: Synthetic oligonucleotide
  Target: ATXN1; (+) strand; PAM type: YTN; PAM sequence: CTG
gcaccaagagatggacagtg

SEQ ID NO: 308222 - DNA, 20 bp, Artificial Sequence
  Description of Artificial Sequence: Synthetic oligonucleotide
  Target: ATXN1; (+) strand; PAM type: YTN; PAM sequence: TTT
tactaaaagattagccacta

SEQ ID NO: 308223 - DNA, 20 bp, Artificial Sequence
  Description of Artificial Sequence: Synthetic oligonucleotide
  Target: ATXN1; (+) strand; PAM type: YTN; PAM sequence: TTT
actaaaagattagccactag

SEQ ID NO: 308224 - DNA, 20 bp, Artificial Sequence
  Description of Artificial Sequence: Synthetic oligonucleotide
  Target: ATXN1; (+) strand; PAM type: YTN; PAM sequence: TTA
ctaaaagattagccactaga

SEQ ID NO: 308225 - DNA, 20 bp, Artificial Sequence
  Description of Artificial Sequence: Synthetic oligonucleotide
  Target: ATXN1; (+) strand; PAM type: YTN; PAM sequence: CTA
aaagattagccactagatgt

SEQ ID NO: 308226 - DNA, 20 bp, Artificial Sequence
  Description of Artificial Sequence: Synthetic oligonucleotide
  Target: ATXN1; (+) strand; PAM type: YTN; PAM sequence: TTA
gccactagatgttgtaacag

SEQ ID NO: 308227 - DNA, 20 bp, Artificial Sequence
  Description of Artificial Sequence: Synthetic oligonucleotide
  Target: ATXN1; (+) strand; PAM type: YTN; PAM sequence: CTA
gatgttgtaacagtagatac

SEQ ID NO: 308228 - DNA, 20 bp, Artificial Sequence
  Description of Artificial Sequence: Synthetic oligonucleotide
  Target: ATXN1; (+) strand; PAM type: YTN; PAM sequence: TTG
taacagtagatacttaatta

SEQ ID NO: 308229 - DNA, 20 bp, Artificial Sequence
  Description of Artificial Sequence: Synthetic oligonucleotide
  Target: ATXN1; (+) strand; PAM type: YTN; PAM sequence: CTT
aattattggggaagtaactc

SEQ ID NO: 308230 - DNA, 20 bp, Artificial Sequence
  Description of Artificial Sequence: Synthetic oligonucleotide
  Target: ATXN1; (+) strand; PAM type: YTN; PAM sequence: TTA
attattggggaagtaactca

SEQ ID NO: 308231 - DNA, 20 bp, Artificial Sequence
  Description of Artificial Sequence: Synthetic oligonucleotide
  Target: ATXN1; (+) strand; PAM type: YTN; PAM sequence: TTA
ttggggaagtaactcatggt

SEQ ID NO: 308232 - DNA, 20 bp, Artificial Sequence
  Description of Artificial Sequence: Synthetic oligonucleotide
  Target: ATXN1; (+) strand; PAM type: YTN; PAM sequence: TTG
gggaagtaactcatggtttt

SEQ ID NO: 308233 - DNA, 20 bp, Artificial Sequence
  Description of Artificial Sequence: Synthetic oligonucleotide
  Target: ATXN1; (+) strand; PAM type: YTN; PAM sequence: CTC
atggtttttgcagatacaaa

SEQ ID NO: 308234 - DNA, 20 bp, Artificial Sequence
  Description of Artificial Sequence: Synthetic oligonucleotide
  Target: ATXN1; (+) strand; PAM type: YTN; PAM sequence: TTT
ttgcagatacaaatgtccag

SEQ ID NO: 308235 - DNA, 20 bp, Artificial Sequence
  Description of Artificial Sequence: Synthetic oligonucleotide
  Target: ATXN1; (+) strand; PAM type: YTN; PAM sequence: TTT
tgcagatacaaatgtccagc

SEQ ID NO: 308236 - DNA, 20 bp, Artificial Sequence
  Description of Artificial Sequence: Synthetic oligonucleotide
  Target: ATXN1; (+) strand; PAM type: YTN; PAM sequence: TTT
gcagatacaaatgtccagca

SEQ ID NO: 308237 - DNA, 20 bp, Artificial Sequence
  Description of Artificial Sequence: Synthetic oligonucleotide
  Target: ATXN1; (+) strand; PAM type: YTN; PAM sequence: TTG
cagatacaaatgtccagcac

SEQ ID NO: 308238 - DNA, 20 bp, Artificial Sequence
  Description of Artificial Sequence: Synthetic oligonucleotide
  Target: ATXN1; (+) strand; PAM type: YTN; PAM sequence: CTC
cttcttgcctagcagaataa

SEQ ID NO: 308239 - DNA, 20 bp, Artificial Sequence
  Description of Artificial Sequence: Synthetic oligonucleotide
  Target: ATXN1; (+) strand; PAM type: YTN; PAM sequence: CTT
cttgcctagcagaataaagc

SEQ ID NO: 308240 - DNA, 20 bp, Artificial Sequence
  Description of Artificial Sequence: Synthetic oligonucleotide
  Target: ATXN1; (+) strand; PAM type: YTN; PAM sequence: TTC
ttgcctagcagaataaagct

SEQ ID NO: 308241 - DNA, 20 bp, Artificial Sequence
  Description of Artificial Sequence: Synthetic oligonucleotide
  Target: ATXN1; (+) strand; PAM type: YTN; PAM sequence: CTT
gcctagcagaataaagctga

SEQ ID NO: 308242 - DNA, 20 bp, Artificial Sequence
  Description of Artificial Sequence: Synthetic oligonucleotide
  Target: ATXN1; (+) strand; PAM type: YTN; PAM sequence: TTG
cctagcagaataaagctgat

SEQ ID NO: 308243 - DNA, 20 bp, Artificial Sequence
  Description of Artificial Sequence: Synthetic oligonucleotide
  Target: ATXN1; (+) strand; PAM type: YTN; PAM sequence: CTA
gcagaataaagctgattcac

SEQ ID NO: 308244 - DNA, 20 bp, Artificial Sequence
  Description of Artificial Sequence: Synthetic oligonucleotide
  Target: ATXN1; (+) strand; PAM type: YTN; PAM sequence: CTG
attcacaggtggctggaaga

SEQ ID NO: 308245 - DNA, 20 bp, Artificial Sequence
  Description of Artificial Sequence: Synthetic oligonucleotide
  Target: ATXN1; (+) strand; PAM type: YTN; PAM sequence: TTC
acaggtggctggaagagctt

SEQ ID NO: 308246 - DNA, 20 bp, Artificial Sequence
  Description of Artificial Sequence: Synthetic oligonucleotide
  Target: ATXN1; (+) strand; PAM type: YTN; PAM sequence: CTG
gaagagcttcttctaatctc

SEQ ID NO: 308247 - DNA, 20 bp, Artificial Sequence
  Description of Artificial Sequence: Synthetic oligonucleotide
  Target: ATXN1; (+) strand; PAM type: YTN; PAM sequence: CTT
cttctaatctcttctgtaac

SEQ ID NO: 308248 - DNA, 20 bp, Artificial Sequence
  Description of Artificial Sequence: Synthetic oligonucleotide
  Target: ATXN1; (+) strand; PAM type: YTN; PAM sequence: TTC
ttctaatctcttctgtaaca

SEQ ID NO: 308249 - DNA, 20 bp, Artificial Sequence
  Description of Artificial Sequence: Synthetic oligonucleotide
  Target: ATXN1; (+) strand; PAM type: YTN; PAM sequence: CTT
ctaatctcttctgtaacatc

SEQ ID NO: 308250 - DNA, 20 bp, Artificial Sequence
  Description of Artificial Sequence: Synthetic oligonucleotide
  Target: ATXN1; (+) strand; PAM type: YTN; PAM sequence: TTC
taatctcttctgtaacatct

SEQ ID NO: 308251 - DNA, 20 bp, Artificial Sequence
  Description of Artificial Sequence: Synthetic oligonucleotide
  Target: ATXN1; (+) strand; PAM type: YTN; PAM sequence: CTA
atctcttctgtaacatctag

SEQ ID NO: 308252 - DNA, 20 bp, Artificial Sequence
  Description of Artificial Sequence: Synthetic oligonucleotide
  Target: ATXN1; (+) strand; PAM type: YTN; PAM sequence: CTC
ttctgtaacatctagtagaa

SEQ ID NO: 308253 - DNA, 20 bp, Artificial Sequence
  Description of Artificial Sequence: Synthetic oligonucleotide
  Target: ATXN1; (+) strand; PAM type: YTN; PAM sequence: CTT
ctgtaacatctagtagaaag

SEQ ID NO: 308254 - DNA, 20 bp, Artificial Sequence
  Description of Artificial Sequence: Synthetic oligonucleotide
  Target: ATXN1; (+) strand; PAM type: YTN; PAM sequence: TTC
tgtaacatctagtagaaaga

SEQ ID NO: 308255 - DNA, 20 bp, Artificial Sequence
  Description of Artificial Sequence: Synthetic oligonucleotide
  Target: ATXN1; (+) strand; PAM type: YTN; PAM sequence: CTG
taacatctagtagaaagaca

SEQ ID NO: 308256 - DNA, 20 bp, Artificial Sequence
  Description of Artificial Sequence: Synthetic oligonucleotide
  Target: ATXN1; (+) strand; PAM type: YTN; PAM sequence: CTA
gtagaaagacagcagatacc

SEQ ID NO: 308257 - DNA, 20 bp, Artificial Sequence
  Description of Artificial Sequence: Synthetic oligonucleotide
  Target: ATXN1; (+) strand; PAM type: YTN; PAM sequence: CTA
cacagagaaatgatctgatt

SEQ ID NO: 308258 - DNA, 20 bp, Artificial Sequence
  Description of Artificial Sequence: Synthetic oligonucleotide
  Target: ATXN1; (+) strand; PAM type: YTN; PAM sequence: CTG
attgtacaatcttcccatcc

SEQ ID NO: 308259 - DNA, 20 bp, Artificial Sequence
  Description of Artificial Sequence: Synthetic oligonucleotide
  Target: ATXN1; (+) strand; PAM type: YTN; PAM sequence: TTG
tacaatcttcccatccacaa

SEQ ID NO: 308260 - DNA, 20 bp, Artificial Sequence
  Description of Artificial Sequence: Synthetic oligonucleotide
  Target: ATXN1; (+) strand; PAM type: YTN; PAM sequence: CTT
cccatccacaaggacttctc

SEQ ID NO: 308261 - DNA, 20 bp, Artificial Sequence
  Description of Artificial Sequence: Synthetic oligonucleotide
  Target: ATXN1; (+) strand; PAM type: YTN; PAM sequence: TTC
ccatccacaaggacttctca

SEQ ID NO: 308262 - DNA, 20 bp, Artificial Sequence
  Description of Artificial Sequence: Synthetic oligonucleotide
  Target: ATXN1; (+) strand; PAM type: YTN; PAM sequence: CTT
ctcagagcagatgacattaa

SEQ ID NO: 308263 - DNA, 20 bp, Artificial Sequence
  Description of Artificial Sequence: Synthetic oligonucleotide
  Target: ATXN1; (+) strand; PAM type: YTN; PAM sequence: TTC
tcagagcagatgacattaaa

SEQ ID NO: 308264 - DNA, 20 bp, Artificial Sequence
  Description of Artificial Sequence: Synthetic oligonucleotide
  Target: ATXN1; (+) strand; PAM type: YTN; PAM sequence: CTC
agagcagatgacattaaatt

SEQ ID NO: 308265 - DNA, 20 bp, Artificial Sequence
  Description of Artificial Sequence: Synthetic oligonucleotide
  Target: ATXN1; (+) strand; PAM type: YTN; PAM sequence: TTA
aatttcaagattccatatat

SEQ ID NO: 308266 - DNA, 20 bp, Artificial Sequence
  Description of Artificial Sequence: Synthetic oligonucleotide
  Target: ATXN1; (+) strand; PAM type: YTN; PAM sequence: TTT
caagattccatatatgagat

SEQ ID NO: 308267 - DNA, 20 bp, Artificial Sequence
  Description of Artificial Sequence: Synthetic oligonucleotide
  Target: ATXN1; (+) strand; PAM type: YTN; PAM sequence: TTC
aagattccatatatgagatc

SEQ ID NO: 308268 - DNA, 20 bp, Artificial Sequence
  Description of Artificial Sequence: Synthetic oligonucleotide
  Target: ATXN1; (+) strand; PAM type: YTN; PAM sequence: TTC
catatatgagatcaatttga

SEQ ID NO: 308269 - DNA, 20 bp, Artificial Sequence
  Description of Artificial Sequence: Synthetic oligonucleotide
  Target: ATXN1; (+) strand; PAM type: YTN; PAM sequence: TTT
gatttcctgatgttttcaac

SEQ ID NO: 308270 - DNA, 20 bp, Artificial Sequence
  Description of Artificial Sequence: Synthetic oligonucleotide
  Target: ATXN1; (+) strand; PAM type: YTN; PAM sequence: TTG
atttcctgatgttttcaacc

SEQ ID NO: 308271 - DNA, 20 bp, Artificial Sequence
  Description of Artificial Sequence: Synthetic oligonucleotide
  Target: ATXN1; (+) strand; PAM type: YTN; PAM sequence: TTT
cctgatgttttcaaccttgc

SEQ ID NO: 308272 - DNA, 20 bp, Artificial Sequence
  Description of Artificial Sequence: Synthetic oligonucleotide
  Target: ATXN1; (+) strand; PAM type: YTN; PAM sequence: TTC
ctgatgttttcaaccttgct

SEQ ID NO: 308273 - DNA, 20 bp, Artificial Sequence
  Description of Artificial Sequence: Synthetic oligonucleotide
  Target: ATXN1; (+) strand; PAM type: YTN; PAM sequence: CTG
atgttttcaaccttgctgtc

SEQ ID NO: 308274 - DNA, 20 bp, Artificial Sequence
  Description of Artificial Sequence: Synthetic oligonucleotide
  Target: ATXN1; (+) strand; PAM type: YTN; PAM sequence: TTT
tcaaccttgctgtcatgggt

SEQ ID NO: 308275 - DNA, 20 bp, Artificial Sequence
  Description of Artificial Sequence: Synthetic oligonucleotide
  Target: ATXN1; (+) strand; PAM type: YTN; PAM sequence: TTT
caaccttgctgtcatgggtg

SEQ ID NO: 308276 - DNA, 20 bp, Artificial Sequence
  Description of Artificial Sequence: Synthetic oligonucleotide
  Target: ATXN1; (+) strand; PAM type: YTN; PAM sequence: TTC
aaccttgctgtcatgggtgc

SEQ ID NO: 308277 - DNA, 20 bp, Artificial Sequence
  Description of Artificial Sequence: Synthetic oligonucleotide
  Target: ATXN1; (+) strand; PAM type: YTN; PAM sequence: CTT
gctgtcatgggtgcattaaa

SEQ ID NO: 308278 - DNA, 20 bp, Artificial Sequence
  Description of Artificial Sequence: Synthetic oligonucleotide
  Target: ATXN1; (+) strand; PAM type: YTN; PAM sequence: TTG
ctgtcatgggtgcattaaag

SEQ ID NO: 308279 - DNA, 20 bp, Artificial Sequence
  Description of Artificial Sequence: Synthetic oligonucleotide
  Target: ATXN1; (+) strand; PAM type: YTN; PAM sequence: CTG
tcatgggtgcattaaaggaa

SEQ ID NO: 308280 - DNA, 20 bp, Artificial Sequence
  Description of Artificial Sequence: Synthetic oligonucleotide
  Target: ATXN1; (+) strand; PAM type: YTN; PAM sequence: TTA
aaggaaatacacctcaaaaa

SEQ ID NO: 308281 - DNA, 20 bp, Artificial Sequence
  Description of Artificial Sequence: Synthetic oligonucleotide
  Target: ATXN1; (+) strand; PAM type: YTN; PAM sequence: CTC
aaaaagctcaactttaaagg

SEQ ID NO: 308282 - DNA, 20 bp, Artificial Sequence
  Description of Artificial Sequence: Synthetic oligonucleotide
  Target: ATXN1; (+) strand; PAM type: YTN; PAM sequence: CTC
aactttaaaggtgcagtggc

SEQ ID NO: 308283 - DNA, 20 bp, Artificial Sequence
  Description of Artificial Sequence: Synthetic oligonucleotide
  Target: ATXN1; (+) strand; PAM type: YTN; PAM sequence: CTT
taaaggtgcagtggctgcaa

SEQ ID NO: 308284 - DNA, 20 bp, Artificial Sequence
  Description of Artificial Sequence: Synthetic oligonucleotide
  Target: ATXN1; (+) strand; PAM type: YTN; PAM sequence: TTT
aaaggtgcagtggctgcaaa

SEQ ID NO: 308285 - DNA, 20 bp, Artificial Sequence
  Description of Artificial Sequence: Synthetic oligonucleotide
  Target: ATXN1; (+) strand; PAM type: YTN; PAM sequence: TTA
aaggtgcagtggctgcaaaa

SEQ ID NO: 308286 - DNA, 20 bp, Artificial Sequence
  Description of Artificial Sequence: Synthetic oligonucleotide
  Target: ATXN1; (+) strand; PAM type: YTN; PAM sequence: CTG
caaaatgaaaatcattctct

SEQ ID NO: 308287 - DNA, 20 bp, Artificial Sequence
  Description of Artificial Sequence: Synthetic oligonucleotide
  Target: ATXN1; (+) strand; PAM type: YTN; PAM sequence: TTC
tctgtttatccatcaagttt

SEQ ID NO: 308288 - DNA, 20 bp, Artificial Sequence
  Description of Artificial Sequence: Synthetic oligonucleotide
  Target: ATXN1; (+) strand; PAM type: YTN; PAM sequence: CTC
tgtttatccatcaagtttag

SEQ ID NO: 308289 - DNA, 20 bp, Artificial Sequence
  Description of Artificial Sequence: Synthetic oligonucleotide
  Target: ATXN1; (+) strand; PAM type: YTN; PAM sequence: CTG
tttatccatcaagtttaggc

SEQ ID NO: 308290 - DNA, 20 bp, Artificial Sequence
  Description of Artificial Sequence: Synthetic oligonucleotide
  Target: ATXN1; (+) strand; PAM type: YTN; PAM sequence: TTT
atccatcaagtttaggctcc

SEQ ID NO: 308291 - DNA, 20 bp, Artificial Sequence
  Description of Artificial Sequence: Synthetic oligonucleotide
  Target: ATXN1; (+) strand; PAM type: YTN; PAM sequence: TTA
tccatcaagtttaggctccg

SEQ ID NO: 308292 - DNA, 20 bp, Artificial Sequence
  Description of Artificial Sequence: Synthetic oligonucleotide
  Target: ATXN1; (+) strand; PAM type: YTN; PAM sequence: TTT
aggctccggcactataaaaa

SEQ ID NO: 308293 - DNA, 20 bp, Artificial Sequence
  Description of Artificial Sequence: Synthetic oligonucleotide
  Target: ATXN1; (+) strand; PAM type: YTN; PAM sequence: TTA
ggctccggcactataaaaac

SEQ ID NO: 308294 - DNA, 20 bp, Artificial Sequence
  Description of Artificial Sequence: Synthetic oligonucleotide
  Target: ATXN1; (+) strand; PAM type: YTN; PAM sequence: CTC
cggcactataaaaacatcta

SEQ ID NO: 308295 - DNA, 20 bp, Artificial Sequence
  Description of Artificial Sequence: Synthetic oligonucleotide
  Target: ATXN1; (+) strand; PAM type: YTN; PAM sequence: CTA
taaaaacatctaacatataa

SEQ ID NO: 308296 - DNA, 20 bp, Artificial Sequence
  Description of Artificial Sequence: Synthetic oligonucleotide
  Target: ATXN1; (+) strand; PAM type: YTN; PAM sequence: CTA
acatataattttttatttat

SEQ ID NO: 308297 - DNA, 20 bp, Artificial Sequence
  Description of Artificial Sequence: Synthetic oligonucleotide
  Target: ATXN1; (+) strand; PAM type: YTN; PAM sequence: TTT
tttatttatttatttatttt

SEQ ID NO: 308298 - DNA, 20 bp, Artificial Sequence
  Description of Artificial Sequence: Synthetic oligonucleotide
  Target: ATXN1; (+) strand; PAM type: YTN; PAM sequence: TTT
ttatttatttatttattttt

SEQ ID NO: 308299 - DNA, 20 bp, Artificial Sequence
  Description of Artificial Sequence: Synthetic oligonucleotide
  Target: ATXN1; (+) strand; PAM type: YTN; PAM sequence: TTT
tatttatttatttatttttt

SEQ ID NO: 308300 - DNA, 20 bp, Artificial Sequence
  Description of Artificial Sequence: Synthetic oligonucleotide
  Target: ATXN1; (+) strand; PAM type: YTN; PAM sequence: TTT
atttatttatttattttttt

SEQ ID NO: 308301 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttttttt

SEQ ID NO: 308302 - DNA, 20 bp, Artificial Sequence
  Description of Artificial Sequence: Synthetic oligonucleotide
  Target: ATXN1; (+) strand; PAM type: YTN; PAM sequence: TTT
atttatttattttttttaga

SEQ ID NO: 308303 - DNA, 20 bp, Artificial Sequence
  Description of Artificial Sequence: Synthetic oligonucleotide
  Target: ATXN1; (+) strand; PAM type: YTN; PAM sequence: TTA
tttatttattttttttagag

SEQ ID NO: 308304 - DNA, 20 bp, Artificial Sequence
  Description of Artificial Sequence: Synthetic oligonucleotide
  Target: ATXN1; (+) strand; PAM type: YTN; PAM sequence: TTT
atttattttttttagagaca

SEQ ID NO: 308305 - DNA, 20 bp, Artificial Sequence
  Description of Artificial Sequence: Synthetic oligonucleotide
  Target: ATXN1; (+) strand; PAM type: YTN; PAM sequence: TTA
tttattttttttagagacag

SEQ ID NO: 308306 - DNA, 20 bp, Artificial Sequence
  Description of Artificial Sequence: Synthetic oligonucleotide
  Target: ATXN1; (+) strand; PAM type: YTN; PAM sequence: TTT
attttttttagagacagggt

SEQ ID NO: 308307 - DNA, 20 bp, Artificial Sequence
  Description of Artificial Sequence: Synthetic oligonucleotide
  Target: ATXN1; (+) strand; PAM type: YTN; PAM sequence: TTA
ttttttttagagacagggtc

SEQ ID NO: 308308 - DNA, 20 bp, Artificial Sequence
  Description of Artificial Sequence: Synthetic oligonucleotide
  Target: ATXN1; (+) strand; PAM type: YTN; PAM sequence: TTT
tttttagagacagggtctca

SEQ ID NO: 308309 - DNA, 20 bp, Artificial Sequence
  Description of Artificial Sequence: Synthetic oligonucleotide
  Target: ATXN1; (+) strand; PAM type: YTN; PAM sequence: TTT
ttttagagacagggtctcac

SEQ ID NO: 308310 - DNA, 20 bp, Artificial Sequence
  Description of Artificial Sequence: Synthetic oligonucleotide
  Target: ATXN1; (+) strand; PAM type: YTN; PAM sequence: TTT
tttagagacagggtctcact

SEQ ID NO: 308311 - DNA, 20 bp, Artificial Sequence
  Description of Artificial Sequence: Synthetic oligonucleotide
  Target: ATXN1; (+) strand; PAM type: YTN; PAM sequence: TTT
ttagagacagggtctcactc

SEQ ID NO: 308312 - DNA, 20 bp, Artificial Sequence
  Description of Artificial Sequence: Synthetic oligonucleotide
  Target: ATXN1; (+) strand; PAM type: YTN; PAM sequence: TTT
tagagacagggtctcactct

SEQ ID NO: 308313 - DNA, 20 bp, Artificial Sequence
  Description of Artificial Sequence: Synthetic oligonucleotide
  Target: ATXN1; (+) strand; PAM type: YTN; PAM sequence: TTT
agagacagggtctcactctg

SEQ ID NO: 308314 - DNA, 20 bp, Artificial Sequence
  Description of Artificial Sequence: Synthetic oligonucleotide
  Target: ATXN1; (+) strand; PAM type: YTN; PAM sequence: TTA
gagacagggtctcactctgt

SEQ ID NO: 308315 - DNA, 20 bp, Artificial Sequence
  Description of Artificial Sequence: Synthetic oligonucleotide
  Target: ATXN1; (+) strand; PAM type: YTN; PAM sequence: CTC
actctgtggcccaggctggt

SEQ ID NO: 308316 - DNA, 20 bp, Artificial Sequence
  Description of Artificial Sequence: Synthetic oligonucleotide
  Target: ATXN1; (+) strand; PAM type: YTN; PAM sequence: CTC
tgtggcccaggctggtcttg

SEQ ID NO: 308317 - DNA, 20 bp, Artificial Sequence
  Description of Artificial Sequence: Synthetic oligonucleotide
  Target: ATXN1; (+) strand; PAM type: YTN; PAM sequence: CTG
tggcccaggctggtcttgaa

SEQ ID NO: 308318 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcctagcctca

SEQ ID NO: 308319 - DNA, 20 bp, Artificial Sequence
  Description of Artificial Sequence: Synthetic oligonucleotide
  Target: ATXN1; (+) strand; PAM type: YTN; PAM sequence: CTT
gaactcctagcctcaggcga

SEQ ID NO: 308320 - DNA, 20 bp, Artificial Sequence
  Description of Artificial Sequence: Synthetic oligonucleotide
  Target: ATXN1; (+) strand; PAM type: YTN; PAM sequence: TTG
aactcctagcctcaggcgat

SEQ ID NO: 308321 - DNA, 20 bp, Artificial Sequence
  Description of Artificial Sequence: Synthetic oligonucleotide
  Target: ATXN1; (+) strand; PAM type: YTN; PAM sequence: CTC
ctagcctcaggcgatcccac

SEQ ID NO: 308322 - DNA, 20 bp, Artificial Sequence
  Description of Artificial Sequence: Synthetic oligonucleotide
  Target: ATXN1; (+) strand; PAM type: YTN; PAM sequence: CTA
gcctcaggcgatcccaccgc

SEQ ID NO: 308323 - DNA, 20 bp, Artificial Sequence
  Description of Artificial Sequence: Synthetic oligonucleotide
  Target: ATXN1; (+) strand; PAM type: YTN; PAM sequence: CTC
aggcgatcccaccgccttgg

SEQ ID NO: 308324 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaaagcactggga

SEQ ID NO: 308325 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagcactgggat

SEQ ID NO: 308326 - DNA, 20 bp, Artificial Sequence
  Description of Artificial Sequence: Synthetic oligonucleotide
  Target: ATXN1; (+) strand; PAM type: YTN; PAM sequence: CTC
ccaaagcactgggattcgag

SEQ ID NO: 308327 - DNA, 20 bp, Artificial Sequence
  Description of Artificial Sequence: Synthetic oligonucleotide
  Target: ATXN1; (+) strand; PAM type: YTN; PAM sequence: CTG
ggattcgaggcatgagccac

SEQ ID NO: 308328 - DNA, 20 bp, Artificial Sequence
  Description of Artificial Sequence: Synthetic oligonucleotide
  Target: ATXN1; (+) strand; PAM type: YTN; PAM sequence: TTC
gaggcatgagccaccatgcc

SEQ ID NO: 308329 - DNA, 20 bp, Artificial Sequence
  Description of Artificial Sequence: Synthetic oligonucleotide
  Target: ATXN1; (+) strand; PAM type: YTN; PAM sequence: CTC
taacatctaaatttataatg

SEQ ID NO: 308330 - DNA, 20 bp, Artificial Sequence
  Description of Artificial Sequence: Synthetic oligonucleotide
  Target: ATXN1; (+) strand; PAM type: YTN; PAM sequence: CTA
acatctaaatttataatgaa

SEQ ID NO: 308331 - DNA, 20 bp, Artificial Sequence
  Description of Artificial Sequence: Synthetic oligonucleotide
  Target: ATXN1; (+) strand; PAM type: YTN; PAM sequence: CTA
aatttataatgaagcactgt

SEQ ID NO: 308332 - DNA, 20 bp, Artificial Sequence
  Description of Artificial Sequence: Synthetic oligonucleotide
  Target: ATXN1; (+) strand; PAM type: YTN; PAM sequence: TTT
ataatgaagcactgtttcaa

SEQ ID NO: 308333 - DNA, 20 bp, Artificial Sequence
  Description of Artificial Sequence: Synthetic oligonucleotide
  Target: ATXN1; (+) strand; PAM type: YTN; PAM sequence: TTA
taatgaagcactgtttcaag

SEQ ID NO: 308334 - DNA, 20 bp, Artificial Sequence
  Description of Artificial Sequence: Synthetic oligonucleotide
  Target: ATXN1; (+) strand; PAM type: YTN; PAM sequence: CTG
tttcaaggggtaactgggaa

SEQ ID NO: 308335 - DNA, 20 bp, Artificial Sequence
  Description of Artificial Sequence: Synthetic oligonucleotide
  Target: ATXN1; (+) strand; PAM type: YTN; PAM sequence: TTT
caaggggtaactgggaattg

SEQ ID NO: 308336 - DNA, 20 bp, Artificial Sequence
  Description of Artificial Sequence: Synthetic oligonucleotide
  Target: ATXN1; (+) strand; PAM type: YTN; PAM sequence: TTC
aaggggtaactgggaattgc

SEQ ID NO: 308337 - DNA, 20 bp, Artificial Sequence
  Description of Artificial Sequence: Synthetic oligonucleotide
  Target: ATXN1; (+) strand; PAM type: YTN; PAM sequence: CTG
ggaattgcacatacccaagg

SEQ ID NO: 308338 - DNA, 20 bp, Artificial Sequence
  Description of Artificial Sequence: Synthetic oligonucleotide
  Target: ATXN1; (+) strand; PAM type: YTN; PAM sequence: TTG
cacatacccaagggattgga

SEQ ID NO: 308339 - DNA, 20 bp, Artificial Sequence
  Description of Artificial Sequence: Synthetic oligonucleotide
  Target: ATXN1; (+) strand; PAM type: YTN; PAM sequence: TTG
gactcttgcatttcttcacc

SEQ ID NO: 308340 - DNA, 20 bp, Artificial Sequence
  Description of Artificial Sequence: Synthetic oligonucleotide
  Target: ATXN1; (+) strand; PAM type: YTN; PAM sequence: CTC
ttgcatttcttcaccattcc

SEQ ID NO: 308341 - DNA, 20 bp, Artificial Sequence
  Description of Artificial Sequence: Synthetic oligonucleotide
  Target: ATXN1; (+) strand; PAM type: YTN; PAM sequence: CTT
gcatttcttcaccattccag

SEQ ID NO: 308342 - DNA, 20 bp, Artificial Sequence
  Description of Artificial Sequence: Synthetic oligonucleotide
  Target: ATXN1; (+) strand; PAM type: YTN; PAM sequence: TTG
catttcttcaccattccagc

SEQ ID NO: 308343 - DNA, 20 bp, Artificial Sequence
  Description of Artificial Sequence: Synthetic oligonucleotide
  Target: ATXN1; (+) strand; PAM type: YTN; PAM sequence: TTT
cttcaccattccagctccat

SEQ ID NO: 308344 - DNA, 20 bp, Artificial Sequence
  Description of Artificial Sequence: Synthetic oligonucleotide
  Target: ATXN1; (+) strand; PAM type: YTN; PAM sequence: TTC
ttcaccattccagctccatc

SEQ ID NO: 308345 - DNA, 20 bp, Artificial Sequence
  Description of Artificial Sequence: Synthetic oligonucleotide
  Target: ATXN1; (+) strand; PAM type: YTN; PAM sequence: CTT
caccattccagctccatctc

SEQ ID NO: 308346 - DNA, 20 bp, Artificial Sequence
  Description of Artificial Sequence: Synthetic oligonucleotide
  Target: ATXN1; (+) strand; PAM type: YTN; PAM sequence: TTC
accattccagctccatctca

SEQ ID NO: 308347 - DNA, 20 bp, Artificial Sequence
  Description of Artificial Sequence: Synthetic oligonucleotide
  Target: ATXN1; (+) strand; PAM type: YTN; PAM sequence: TTC
cagctccatctcaatattgt

SEQ ID NO: 308348 - DNA, 20 bp, Artificial Sequence
  Description of Artificial Sequence: Synthetic oligonucleotide
  Target: ATXN1; (+) strand; PAM type: YTN; PAM sequence: CTC
catctcaatattgttctagg

SEQ ID NO: 308349 - DNA, 20 bp, Artificial Sequence
  Description of Artificial Sequence: Synthetic oligonucleotide
  Target: ATXN1; (+) strand; PAM type: YTN; PAM sequence: CTC
aatattgttctagggggcta

SEQ ID NO: 308350 - DNA, 20 bp, Artificial Sequence
  Description of Artificial Sequence: Synthetic oligonucleotide
  Target: ATXN1; (+) strand; PAM type: YTN; PAM sequence: TTG
ttctagggggctaactcagt

SEQ ID NO: 308351 - DNA, 20 bp, Artificial Sequence
  Description of Artificial Sequence: Synthetic oligonucleotide
  Target: ATXN1; (+) strand; PAM type: YTN; PAM sequence: TTC
tagggggctaactcagttaa

SEQ ID NO: 308352 - DNA, 20 bp, Artificial Sequence
  Description of Artificial Sequence: Synthetic oligonucleotide
  Target: ATXN1; (+) strand; PAM type: YTN; PAM sequence: CTA
gggggctaactcagttaagc

SEQ ID NO: 308353 - DNA, 20 bp, Artificial Sequence
  Description of Artificial Sequence: Synthetic oligonucleotide
  Target: ATXN1; (+) strand; PAM type: YTN; PAM sequence: CTA
actcagttaagcaaagacat

SEQ ID NO: 308354 - DNA, 20 bp, Artificial Sequence
  Description of Artificial Sequence: Synthetic oligonucleotide
  Target: ATXN1; (+) strand; PAM type: YTN; PAM sequence: CTC
agttaagcaaagacatgtct

SEQ ID NO: 308355 - DNA, 20 bp, Artificial Sequence
  Description of Artificial Sequence: Synthetic oligonucleotide
  Target: ATXN1; (+) strand; PAM type: YTN; PAM sequence: TTA
agcaaagacatgtcttttca

SEQ ID NO: 308356 - DNA, 20 bp, Artificial Sequence
  Description of Artificial Sequence: Synthetic oligonucleotide
  Target: ATXN1; (+) strand; PAM type: YTN; PAM sequence: CTT
ttcatcctacaacttcggaa

SEQ ID NO: 308357 - DNA, 20 bp, Artificial Sequence
  Description of Artificial Sequence: Synthetic oligonucleotide
  Target: ATXN1; (+) strand; PAM type: YTN; PAM sequence: TTT
tcatcctacaacttcggaaa

SEQ ID NO: 308358 - DNA, 20 bp, Artificial Sequence
  Description of Artificial Sequence: Synthetic oligonucleotide
  Target: ATXN1; (+) strand; PAM type: YTN; PAM sequence: TTT
catcctacaacttcggaaac

SEQ ID NO: 308359 - DNA, 20 bp, Artificial Sequence
  Description of Artificial Sequence: Synthetic oligonucleotide
  Target: ATXN1; (+) strand; PAM type: YTN; PAM sequence: TTC
atcctacaacttcggaaacg

SEQ ID NO: 308360 - DNA, 20 bp, Artificial Sequence
  Description of Artificial Sequence: Synthetic oligonucleotide
  Target: ATXN1; (+) strand; PAM type: YTN; PAM sequence: CTA
caacttcggaaacgcaaata

SEQ ID NO: 308361 - DNA, 20 bp, Artificial Sequence
  Description of Artificial Sequence: Synthetic oligonucleotide
  Target: ATXN1; (+) strand; PAM type: YTN; PAM sequence: CTT
cggaaacgcaaataatttct

SEQ ID NO: 308362 - DNA, 20 bp, Artificial Sequence
  Description of Artificial Sequence: Synthetic oligonucleotide
  Target: ATXN1; (+) strand; PAM type: YTN; PAM sequence: TTC
ggaaacgcaaataatttctg

SEQ ID NO: 308363 - DNA, 20 bp, Artificial Sequence
  Description of Artificial Sequence: Synthetic oligonucleotide
  Target: ATXN1; (+) strand; PAM type: YTN; PAM sequence: TTT
ctggggtatcttggctgtac

SEQ ID NO: 308364 - DNA, 20 bp, Artificial Sequence
  Description of Artificial Sequence: Synthetic oligonucleotide
  Target: ATXN1; (+) strand; PAM type: YTN; PAM sequence: TTC
tggggtatcttggctgtaca

SEQ ID NO: 308365 - DNA, 20 bp, Artificial Sequence
  Description of Artificial Sequence: Synthetic oligonucleotide
  Target: ATXN1; (+) strand; PAM type: YTN; PAM sequence: CTG
gggtatcttggctgtacaag

SEQ ID NO: 308366 - DNA, 20 bp, Artificial Sequence
  Description of Artificial Sequence: Synthetic oligonucleotide
  Target: ATXN1; (+) strand; PAM type: YTN; PAM sequence: CTT
ggctgtacaaggagatggag

SEQ ID NO: 308367 - DNA, 20 bp, Artificial Sequence
  Description of Artificial Sequence: Synthetic oligonucleotide
  Target: ATXN1; (+) strand; PAM type: YTN; PAM sequence: TTG
gctgtacaaggagatggaga

SEQ ID NO: 308368 - DNA, 20 bp, Artificial Sequence
  Description of Artificial Sequence: Synthetic oligonucleotide
  Target: ATXN1; (+) strand; PAM type: YTN; PAM sequence: CTG
tacaaggagatggagaagag

SEQ ID NO: 308369 - DNA, 20 bp, Artificial Sequence
  Description of Artificial Sequence: Synthetic oligonucleotide
  Target: ATXN1; (+) strand; PAM type: YTN; PAM sequence: CTG
aactacaagtcagaaaatca

SEQ ID NO: 308370 - DNA, 20 bp, Artificial Sequence
  Description of Artificial Sequence: Synthetic oligonucleotide
  Target: ATXN1; (+) strand; PAM type: YTN; PAM sequence: CTA
caagtcagaaaatcaggttt

SEQ ID NO: 308371 - DNA, 20 bp, Artificial Sequence
  Description of Artificial Sequence: Synthetic oligonucleotide
  Target: ATXN1; (+) strand; PAM type: YTN; PAM sequence: TTT
acagcacaggctacatgtat

SEQ ID NO: 308372 - DNA, 20 bp, Artificial Sequence
  Description of Artificial Sequence: Synthetic oligonucleotide
  Target: ATXN1; (+) strand; PAM type: YTN; PAM sequence: TTA
cagcacaggctacatgtatt

SEQ ID NO: 308373 - DNA, 20 bp, Artificial Sequence
  Description of Artificial Sequence: Synthetic oligonucleotide
  Target: ATXN1; (+) strand; PAM type: YTN; PAM sequence: CTA
catgtatttctaaccactgg

SEQ ID NO: 308374 - DNA, 20 bp, Artificial Sequence
  Description of Artificial Sequence: Synthetic oligonucleotide
  Target: ATXN1; (+) strand; PAM type: YTN; PAM sequence: TTT
ctaaccactggaatctagta

SEQ ID NO: 308375 - DNA, 20 bp, Artificial Sequence
  Description of Artificial Sequence: Synthetic oligonucleotide
  Target: ATXN1; (+) strand; PAM type: YTN; PAM sequence: TTC
taaccactggaatctagtaa

SEQ ID NO: 308376 - DNA, 20 bp, Artificial Sequence
  Description of Artificial Sequence: Synthetic oligonucleotide
  Target: ATXN1; (+) strand; PAM type: YTN; PAM sequence: CTA
accactggaatctagtaaat

SEQ ID NO: 308377 - DNA, 20 bp, Artificial Sequence
  Description of Artificial Sequence: Synthetic oligonucleotide
  Target: ATXN1; (+) strand; PAM type: YTN; PAM sequence: CTG
gaatctagtaaatcagtcaa

SEQ ID NO: 308378 - DNA, 20 bp, Artificial Sequence
  Description of Artificial Sequence: Synthetic oligonucleotide
  Target: ATXN1; (+) strand; PAM type: YTN; PAM sequence: CTA
gtaaatcagtcaacctcgta

SEQ ID NO: 308379 - DNA, 20 bp, Artificial Sequence
  Description of Artificial Sequence: Synthetic oligonucleotide
  Target: ATXN1; (+) strand; PAM type: YTN; PAM sequence: CTC
gtaggttctgttttctcccc

SEQ ID NO: 308380 - DNA, 20 bp, Artificial Sequence
  Description of Artificial Sequence: Synthetic oligonucleotide
  Target: ATXN1; (+) strand; PAM type: YTN; PAM sequence: TTC
tgttttctcccctagaaaat

SEQ ID NO: 308381 - DNA, 20 bp, Artificial Sequence
  Description of Artificial Sequence: Synthetic oligonucleotide
  Target: ATXN1; (+) strand; PAM type: YTN; PAM sequence: CTG
ttttctcccctagaaaatga

SEQ ID NO: 308382 - DNA, 20 bp, Artificial Sequence
  Description of Artificial Sequence: Synthetic oligonucleotide
  Target: ATXN1; (+) strand; PAM type: YTN; PAM sequence: TTT
tctcccctagaaaatgaggg

SEQ ID NO: 308383 - DNA, 20 bp, Artificial Sequence
  Description of Artificial Sequence: Synthetic oligonucleotide
  Target: ATXN1; (+) strand; PAM type: YTN; PAM sequence: TTT
ctcccctagaaaatgagggt

SEQ ID NO: 308384 - DNA, 20 bp, Artificial Sequence
  Description of Artificial Sequence: Synthetic oligonucleotide
  Target: ATXN1; (+) strand; PAM type: YTN; PAM sequence: TTC
tcccctagaaaatgagggta

SEQ ID NO: 308385 - DNA, 20 bp, Artificial Sequence
  Description of Artificial Sequence: Synthetic oligonucleotide
  Target: ATXN1; (+) strand; PAM type: YTN; PAM sequence: CTC
ccctagaaaatgagggtact

SEQ ID NO: 308386 - DNA, 20 bp, Artificial Sequence
  Description of Artificial Sequence: Synthetic oligonucleotide
  Target: ATXN1; (+) strand; PAM type: YTN; PAM sequence: CTA
gaaaatgagggtacttttct

SEQ ID NO: 308387 - DNA, 20 bp, Artificial Sequence
  Description of Artificial Sequence: Synthetic oligonucleotide
  Target: ATXN1; (+) strand; PAM type: YTN; PAM sequence: CTT
ttctactcaagcagtcatta

SEQ ID NO: 308388 - DNA, 20 bp, Artificial Sequence
  Description of Artificial Sequence: Synthetic oligonucleotide
  Target: ATXN1; (+) strand; PAM type: YTN; PAM sequence: TTT
tctactcaagcagtcattat

SEQ ID NO: 308389 - DNA, 20 bp, Artificial Sequence
  Description of Artificial Sequence: Synthetic oligonucleotide
  Target: ATXN1; (+) strand; PAM type: YTN; PAM sequence: TTT
ctactcaagcagtcattatg

SEQ ID NO: 308390 - DNA, 20 bp, Artificial Sequence
  Description of Artificial Sequence: Synthetic oligonucleotide
  Target: ATXN1; (+) strand; PAM type: YTN; PAM sequence: TTC
tactcaagcagtcattatga

SEQ ID NO: 308391 - DNA, 20 bp, Artificial Sequence
  Description of Artificial Sequence: Synthetic oligonucleotide
  Target: ATXN1; (+) strand; PAM type: YTN; PAM sequence: CTA
ctcaagcagtcattatgact

SEQ ID NO: 308392 - DNA, 20 bp, Artificial Sequence
  Description of Artificial Sequence: Synthetic oligonucleotide
  Target: ATXN1; (+) strand; PAM type: YTN; PAM sequence: CTC
aagcagtcattatgactatc

SEQ ID NO: 308393 - DNA, 20 bp, Artificial Sequence
  Description of Artificial Sequence: Synthetic oligonucleotide
  Target: ATXN1; (+) strand; PAM type: YTN; PAM sequence: TTA
tgactatccactgaaacaat

SEQ ID NO: 308394 - DNA, 20 bp, Artificial Sequence
  Description of Artificial Sequence: Synthetic oligonucleotide
  Target: ATXN1; (+) strand; PAM type: YTN; PAM sequence: CTA
tccactgaaacaatttatct

SEQ ID NO: 308395 - DNA, 20 bp, Artificial Sequence
  Description of Artificial Sequence: Synthetic oligonucleotide
  Target: ATXN1; (+) strand; PAM type: YTN; PAM sequence: CTG
aaacaatttatctaaggcac

SEQ ID NO: 308396 - DNA, 20 bp, Artificial Sequence
  Description of Artificial Sequence: Synthetic oligonucleotide
  Target: ATXN1; (+) strand; PAM type: YTN; PAM sequence: TTT
atctaaggcactctgaattc

SEQ ID NO: 308397 - DNA, 20 bp, Artificial Sequence
  Description of Artificial Sequence: Synthetic oligonucleotide
  Target: ATXN1; (+) strand; PAM type: YTN; PAM sequence: TTA
tctaaggcactctgaattct

SEQ ID NO: 308398 - DNA, 20 bp, Artificial Sequence
  Description of Artificial Sequence: Synthetic oligonucleotide
  Target: ATXN1; (+) strand; PAM type: YTN; PAM sequence: CTA
aggcactctgaattctgtga

SEQ ID NO: 308399 - DNA, 20 bp, Artificial Sequence
  Description of Artificial Sequence: Synthetic oligonucleotide
  Target: ATXN1; (+) strand; PAM type: YTN; PAM sequence: CTC
tgaattctgtgatgtgctat

SEQ ID NO: 308400 - DNA, 20 bp, Artificial Sequence
  Description of Artificial Sequence: Synthetic oligonucleotide
  Target: ATXN1; (+) strand; PAM type: YTN; PAM sequence: CTG
aattctgtgatgtgctatta

SEQ ID NO: 308401 - DNA, 20 bp, Artificial Sequence
  Description of Artificial Sequence: Synthetic oligonucleotide
  Target: ATXN1; (+) strand; PAM type: YTN; PAM sequence: TTC
tgtgatgtgctattatcagc

SEQ ID NO: 308402 - DNA, 20 bp, Artificial Sequence
  Description of Artificial Sequence: Synthetic oligonucleotide
  Target: ATXN1; (+) strand; PAM type: YTN; PAM sequence: CTG
tgatgtgctattatcagctg

SEQ ID NO: 308403 - DNA, 20 bp, Artificial Sequence
  Description of Artificial Sequence: Synthetic oligonucleotide
  Target: ATXN1; (+) strand; PAM type: YTN; PAM sequence: CTA
ttatcagctgaggcagactc

SEQ ID NO: 308404 - DNA, 20 bp, Artificial Sequence
  Description of Artificial Sequence: Synthetic oligonucleotide
  Target: ATXN1; (+) strand; PAM type: YTN; PAM sequence: TTA
tcagctgaggcagactcatg

SEQ ID NO: 308405 - DNA, 20 bp, Artificial Sequence
  Description of Artificial Sequence: Synthetic oligonucleotide
  Target: ATXN1; (+) strand; PAM type: YTN; PAM sequence: CTG
aggcagactcatgacacatt

SEQ ID NO: 308406 - DNA, 20 bp, Artificial Sequence
  Description of Artificial Sequence: Synthetic oligonucleotide
  Target: ATXN1; (+) strand; PAM type: YTN; PAM sequence: CTC
atgacacattaaccactgca

SEQ ID NO: 308407 - DNA, 20 bp, Artificial Sequence
  Description of Artificial Sequence: Synthetic oligonucleotide
  Target: ATXN1; (+) strand; PAM type: YTN; PAM sequence: TTA
accactgcacatggtctgga

SEQ ID NO: 308408 - DNA, 20 bp, Artificial Sequence
  Description of Artificial Sequence: Synthetic oligonucleotide
  Target: ATXN1; (+) strand; PAM type: YTN; PAM sequence: CTG
cacatggtctggataactgt

SEQ ID NO: 308409 - DNA, 20 bp, Artificial Sequence
  Description of Artificial Sequence: Synthetic oligonucleotide
  Target: ATXN1; (+) strand; PAM type: YTN; PAM sequence: CTG
gataactgtggttttaaagg

SEQ ID NO: 308410 - DNA, 20 bp, Artificial Sequence
  Description of Artificial Sequence: Synthetic oligonucleotide
  Target: ATXN1; (+) strand; PAM type: YTN; PAM sequence: CTG
tggttttaaaggctgtagtt

SEQ ID NO: 308411 - DNA, 20 bp, Artificial Sequence
  Description of Artificial Sequence: Synthetic oligonucleotide
  Target: ATXN1; (+) strand; PAM type: YTN; PAM sequence: TTT
taaaggctgtagttactaaa

SEQ ID NO: 308412 - DNA, 20 bp, Artificial Sequence
  Description of Artificial Sequence: Synthetic oligonucleotide
  Target: ATXN1; (+) strand; PAM type: YTN; PAM sequence: TTT
aaaggctgtagttactaaat

SEQ ID NO: 308413 - DNA, 20 bp, Artificial Sequence
  Description of Artificial Sequence: Synthetic oligonucleotide
  Target: ATXN1; (+) strand; PAM type: YTN; PAM sequence: TTA
aaggctgtagttactaaatc

SEQ ID NO: 308414 - DNA, 20 bp, Artificial Sequence
  Description of Artificial Sequence: Synthetic oligonucleotide
  Target: ATXN1; (+) strand; PAM type: YTN; PAM sequence: CTG
tagttactaaatcagaggct

SEQ ID NO: 308415 - DNA, 20 bp, Artificial Sequence
  Description of Artificial Sequence: Synthetic oligonucleotide
  Target: ATXN1; (+) strand; PAM type: YTN; PAM sequence: TTA
ctaaatcagaggctcagact

SEQ ID NO: 308416 - DNA, 20 bp, Artificial Sequence
  Description of Artificial Sequence: Synthetic oligonucleotide
  Target: ATXN1; (+) strand; PAM type: YTN; PAM sequence: CTA
aatcagaggctcagactgca

SEQ ID NO: 308417 - DNA, 20 bp, Artificial Sequence
  Description of Artificial Sequence: Synthetic oligonucleotide
  Target: ATXN1; (+) strand; PAM type: YTN; PAM sequence: CTC
agactgcagaataccatcaa

SEQ ID NO: 308418 - DNA, 20 bp, Artificial Sequence
  Description of Artificial Sequence: Synthetic oligonucleotide
  Target: ATXN1; (+) strand; PAM type: YTN; PAM sequence: CTG
cagaataccatcaagagaaa

SEQ ID NO: 308419 - DNA, 20 bp, Artificial Sequence
  Description of Artificial Sequence: Synthetic oligonucleotide
  Target: ATXN1; (+) strand; PAM type: YTN; PAM sequence: CTT
ttgactagtcctacaagaga

SEQ ID NO: 308420 - DNA, 20 bp, Artificial Sequence
  Description of Artificial Sequence: Synthetic oligonucleotide
  Target: ATXN1; (+) strand; PAM type: YTN; PAM sequence: TTT
tgactagtcctacaagagaa

SEQ ID NO: 308421 - DNA, 20 bp, Artificial Sequence
  Description of Artificial Sequence: Synthetic oligonucleotide
  Target: ATXN1; (+) strand; PAM type: YTN; PAM sequence: TTT
gactagtcctacaagagaaa

SEQ ID NO: 308422 - DNA, 20 bp, Artificial Sequence
  Description of Artificial Sequence: Synthetic oligonucleotide
  Target: ATXN1; (+) strand; PAM type: YTN; PAM sequence: TTG
actagtcctacaagagaaac

SEQ ID NO: 308423 - DNA, 20 bp, Artificial Sequence
  Description of Artificial Sequence: Synthetic oligonucleotide
  Target: ATXN1; (+) strand; PAM type: YTN; PAM sequence: CTA
gtcctacaagagaaacagga

SEQ ID NO: 308424 - DNA, 20 bp, Artificial Sequence
  Description of Artificial Sequence: Synthetic oligonucleotide
  Target: ATXN1; (+) strand; PAM type: YTN; PAM sequence: CTA
caagagaaacaggaaacaca

SEQ ID NO: 308425 - DNA, 20 bp, Artificial Sequence
  Description of Artificial Sequence: Synthetic oligonucleotide
  Target: ATXN1; (+) strand; PAM type: YTN; PAM sequence: CTT
tcctcccagtatactctttg

SEQ ID NO: 308426 - DNA, 20 bp, Artificial Sequence
  Description of Artificial Sequence: Synthetic oligonucleotide
  Target: ATXN1; (+) strand; PAM type: YTN; PAM sequence: TTT
cctcccagtatactctttga

SEQ ID NO: 308427 - DNA, 20 bp, Artificial Sequence
  Description of Artificial Sequence: Synthetic oligonucleotide
  Target: ATXN1; (+) strand; PAM type: YTN; PAM sequence: TTC
ctcccagtatactctttgaa

SEQ ID NO: 308428 - DNA, 20 bp, Artificial Sequence
  Description of Artificial Sequence: Synthetic oligonucleotide
  Target: ATXN1; (+) strand; PAM type: YTN; PAM sequence: CTC
ccagtatactctttgaagac

SEQ ID NO: 308429 - DNA, 20 bp, Artificial Sequence
  Description of Artificial Sequence: Synthetic oligonucleotide
  Target: ATXN1; (+) strand; PAM type: YTN; PAM sequence: CTC
tttgaagaccctggacattt

SEQ ID NO: 308430 - DNA, 20 bp, Artificial Sequence
  Description of Artificial Sequence: Synthetic oligonucleotide
  Target: ATXN1; (+) strand; PAM type: YTN; PAM sequence: CTT
tgaagaccctggacatttaa

SEQ ID NO: 308431 - DNA, 20 bp, Artificial Sequence
  Description of Artificial Sequence: Synthetic oligonucleotide
  Target: ATXN1; (+) strand; PAM type: YTN; PAM sequence: TTT
gaagaccctggacatttaaa

SEQ ID NO: 308432 - DNA, 20 bp, Artificial Sequence
  Description of Artificial Sequence: Synthetic oligonucleotide
  Target: ATXN1; (+) strand; PAM type: YTN; PAM sequence: TTG
aagaccctggacatttaaaa

SEQ ID NO: 308433 - DNA, 20 bp, Artificial Sequence
  Description of Artificial Sequence: Synthetic oligonucleotide
  Target: ATXN1; (+) strand; PAM type: YTN; PAM sequence: CTG
gacatttaaaatgagaaagt

SEQ ID NO: 308434 - DNA, 20 bp, Artificial Sequence
  Description of Artificial Sequence: Synthetic oligonucleotide
  Target: ATXN1; (+) strand; PAM type: YTN; PAM sequence: TTT
aaaatgagaaagttttaaga

SEQ ID NO: 308435 - DNA, 20 bp, Artificial Sequence
  Description of Artificial Sequence: Synthetic oligonucleotide
  Target: ATXN1; (+) strand; PAM type: YTN; PAM sequence: TTA
aaatgagaaagttttaagaa

SEQ ID NO: 308436 - DNA, 20 bp, Artificial Sequence
  Description of Artificial Sequence: Synthetic oligonucleotide
  Target: ATXN1; (+) strand; PAM type: YTN; PAM sequence: TTT
taagaacactttttttaaag

SEQ ID NO: 308437 - DNA, 20 bp, Artificial Sequence
  Description of Artificial Sequence: Synthetic oligonucleotide
  Target: ATXN1; (+) strand; PAM type: YTN; PAM sequence: TTT
aagaacactttttttaaagg

SEQ ID NO: 308438 - DNA, 20 bp, Artificial Sequence
  Description of Artificial Sequence: Synthetic oligonucleotide
  Target: ATXN1; (+) strand; PAM type: YTN; PAM sequence: TTA
agaacactttttttaaagga

SEQ ID NO: 308439 - DNA, 20 bp, Artificial Sequence
  Description of Artificial Sequence: Synthetic oligonucleotide
  Target: ATXN1; (+) strand; PAM type: YTN; PAM sequence: CTT
tttttaaaggaagtctcatt

SEQ ID NO: 308440 - DNA, 20 bp, Artificial Sequence
  Description of Artificial Sequence: Synthetic oligonucleotide
  Target: ATXN1; (+) strand; PAM type: YTN; PAM sequence: TTT
ttttaaaggaagtctcattt

SEQ ID NO: 308441 - DNA, 20 bp, Artificial Sequence
  Description of Artificial Sequence: Synthetic oligonucleotide
  Target: ATXN1; (+) strand; PAM type: YTN; PAM sequence: TTT
tttaaaggaagtctcatttc

SEQ ID NO: 308442 - DNA, 20 bp, Artificial Sequence
  Description of Artificial Sequence: Synthetic oligonucleotide
  Target: ATXN1; (+) strand; PAM type: YTN; PAM sequence: TTT
ttaaaggaagtctcatttct

SEQ ID NO: 308443 - DNA, 20 bp, Artificial Sequence
  Description of Artificial Sequence: Synthetic oligonucleotide
  Target: ATXN1; (+) strand; PAM type: YTN; PAM sequence: TTT
taaaggaagtctcatttctt

SEQ ID NO: 308444 - DNA, 20 bp, Artificial Sequence
  Description of Artificial Sequence: Synthetic oligonucleotide
  Target: ATXN1; (+) strand; PAM type: YTN; PAM sequence: TTT
aaaggaagtctcatttcttg

SEQ ID NO: 308445 - DNA, 20 bp, Artificial Sequence
  Description of Artificial Sequence: Synthetic oligonucleotide
  Target: ATXN1; (+) strand; PAM type: YTN; PAM sequence: TTA
aaggaagtctcatttcttga

SEQ ID NO: 308446 - DNA, 20 bp, Artificial Sequence
  Description of Artificial Sequence: Synthetic oligonucleotide
  Target: ATXN1; (+) strand; PAM type: YTN; PAM sequence: CTC
atttcttgagacttcagggc

SEQ ID NO: 308447 - DNA, 20 bp, Artificial Sequence
  Description of Artificial Sequence: Synthetic oligonucleotide
  Target: ATXN1; (+) strand; PAM type: YTN; PAM sequence: TTT
cttgagacttcagggcaaaa

SEQ ID NO: 308448 - DNA, 20 bp, Artificial Sequence
  Description of Artificial Sequence: Synthetic oligonucleotide
  Target: ATXN1; (+) strand; PAM type: YTN; PAM sequence: TTC
ttgagacttcagggcaaaaa

SEQ ID NO: 308449 - DNA, 20 bp, Artificial Sequence
  Description of Artificial Sequence: Synthetic oligonucleotide
  Target: ATXN1; (+) strand; PAM type: YTN; PAM sequence: CTT
gagacttcagggcaaaaagt

SEQ ID NO: 308450 - DNA, 20 bp, Artificial Sequence
  Description of Artificial Sequence: Synthetic oligonucleotide
  Target: ATXN1; (+) strand; PAM type: YTN; PAM sequence: TTG
agacttcagggcaaaaagtt

SEQ ID NO: 308451 - DNA, 20 bp, Artificial Sequence
  Description of Artificial Sequence: Synthetic oligonucleotide
  Target: ATXN1; (+) strand; PAM type: YTN; PAM sequence: CTT
cagggcaaaaagttaaatta

SEQ ID NO: 308452 - DNA, 20 bp, Artificial Sequence
  Description of Artificial Sequence: Synthetic oligonucleotide
  Target: ATXN1; (+) strand; PAM type: YTN; PAM sequence: TTC
agggcaaaaagttaaattaa

SEQ ID NO: 308453 - DNA, 20 bp, Artificial Sequence
  Description of Artificial Sequence: Synthetic oligonucleotide
  Target: ATXN1; (+) strand; PAM type: YTN; PAM sequence: TTA
aattaagtgcacccttcaga

SEQ ID NO: 308454 - DNA, 20 bp, Artificial Sequence
  Description of Artificial Sequence: Synthetic oligonucleotide
  Target: ATXN1; (+) strand; PAM type: YTN; PAM sequence: TTA
agtgcacccttcagagacag

SEQ ID NO: 308455 - DNA, 20 bp, Artificial Sequence
  Description of Artificial Sequence: Synthetic oligonucleotide
  Target: ATXN1; (+) strand; PAM type: YTN; PAM sequence: CTT
cagagacagaaactttgcga

SEQ ID NO: 308456 - DNA, 20 bp, Artificial Sequence
  Description of Artificial Sequence: Synthetic oligonucleotide
  Target: ATXN1; (+) strand; PAM type: YTN; PAM sequence: TTC
agagacagaaactttgcgat

SEQ ID NO: 308457 - DNA, 20 bp, Artificial Sequence
  Description of Artificial Sequence: Synthetic oligonucleotide
  Target: ATXN1; (+) strand; PAM type: YTN; PAM sequence: CTT
tgcgatttcaggtcaccgaa

SEQ ID NO: 308458 - DNA, 20 bp, Artificial Sequence
  Description of Artificial Sequence: Synthetic oligonucleotide
  Target: ATXN1; (+) strand; PAM type: YTN; PAM sequence: TTT
gcgatttcaggtcaccgaat

SEQ ID NO: 308459 - DNA, 20 bp, Artificial Sequence
  Description of Artificial Sequence: Synthetic oligonucleotide
  Target: ATXN1; (+) strand; PAM type: YTN; PAM sequence: TTG
cgatttcaggtcaccgaatg

SEQ ID NO: 308460 - DNA, 20 bp, Artificial Sequence
  Description of Artificial Sequence: Synthetic oligonucleotide
  Target: ATXN1; (+) strand; PAM type: YTN; PAM sequence: TTT
caggtcaccgaatgttctct

SEQ ID NO: 308461 - DNA, 20 bp, Artificial Sequence
  Description of Artificial Sequence: Synthetic oligonucleotide
  Target: ATXN1; (+) strand; PAM type: YTN; PAM sequence: TTC
aggtcaccgaatgttctctg

SEQ ID NO: 308462 - DNA, 20 bp, Artificial Sequence
  Description of Artificial Sequence: Synthetic oligonucleotide
  Target: ATXN1; (+) strand; PAM type: YTN; PAM sequence: TTC
tctgtacagcaggacagcca

SEQ ID NO: 308463 - DNA, 20 bp, Artificial Sequence
  Description of Artificial Sequence: Synthetic oligonucleotide
  Target: ATXN1; (+) strand; PAM type: YTN; PAM sequence: CTC
tgtacagcaggacagccaac

SEQ ID NO: 308464 - DNA, 20 bp, Artificial Sequence
  Description of Artificial Sequence: Synthetic oligonucleotide
  Target: ATXN1; (+) strand; PAM type: YTN; PAM sequence: CTG
tacagcaggacagccaacag

SEQ ID NO: 308465 - DNA, 20 bp, Artificial Sequence
  Description of Artificial Sequence: Synthetic oligonucleotide
  Target: ATXN1; (+) strand; PAM type: YTN; PAM sequence: CTG
tgtttggtcatttacacata

SEQ ID NO: 308466 - DNA, 20 bp, Artificial Sequence
  Description of Artificial Sequence: Synthetic oligonucleotide
  Target: ATXN1; (+) strand; PAM type: YTN; PAM sequence: TTT
ggtcatttacacatattaaa

SEQ ID NO: 308467 - DNA, 20 bp, Artificial Sequence
  Description of Artificial Sequence: Synthetic oligonucleotide
  Target: ATXN1; (+) strand; PAM type: YTN; PAM sequence: TTG
gtcatttacacatattaaaa

SEQ ID NO: 308468 - DNA, 20 bp, Artificial Sequence
  Description of Artificial Sequence: Synthetic oligonucleotide
  Target: ATXN1; (+) strand; PAM type: YTN; PAM sequence: TTT
acacatattaaaaaaccctc

SEQ ID NO: 308469 - DNA, 20 bp, Artificial Sequence
  Description of Artificial Sequence: Synthetic oligonucleotide
  Target: ATXN1; (+) strand; PAM type: YTN; PAM sequence: TTA
cacatattaaaaaaccctcc

SEQ ID NO: 308470 - DNA, 20 bp, Artificial Sequence
  Description of Artificial Sequence: Synthetic oligonucleotide
  Target: ATXN1; (+) strand; PAM type: YTN; PAM sequence: TTA
aaaaaccctccctccaggac

SEQ ID NO: 308471 - DNA, 20 bp, Artificial Sequence
  Description of Artificial Sequence: Synthetic oligonucleotide
  Target: ATXN1; (+) strand; PAM type: YTN; PAM sequence: CTC
cctccaggacttaaagatga

SEQ ID NO: 308472 - DNA, 20 bp, Artificial Sequence
  Description of Artificial Sequence: Synthetic oligonucleotide
  Target: ATXN1; (+) strand; PAM type: YTN; PAM sequence: CTC
caggacttaaagatgatatg

SEQ ID NO: 308473 - DNA, 20 bp, Artificial Sequence
  Description of Artificial Sequence: Synthetic oligonucleotide
  Target: ATXN1; (+) strand; PAM type: YTN; PAM sequence: CTT
aaagatgatatgaactgtgt

SEQ ID NO: 308474 - DNA, 20 bp, Artificial Sequence
  Description of Artificial Sequence: Synthetic oligonucleotide
  Target: ATXN1; (+) strand; PAM type: YTN; PAM sequence: TTA
aagatgatatgaactgtgtc

SEQ ID NO: 308475 - DNA, 20 bp, Artificial Sequence
  Description of Artificial Sequence: Synthetic oligonucleotide
  Target: ATXN1; (+) strand; PAM type: YTN; PAM sequence: CTG
tgtcatggagtttagtctga

SEQ ID NO: 308476 - DNA, 20 bp, Artificial Sequence
  Description of Artificial Sequence: Synthetic oligonucleotide
  Target: ATXN1; (+) strand; PAM type: YTN; PAM sequence: TTT
agtctgaggaaggctcatat

SEQ ID NO: 308477 - DNA, 20 bp, Artificial Sequence
  Description of Artificial Sequence: Synthetic oligonucleotide
  Target: ATXN1; (+) strand; PAM type: YTN; PAM sequence: TTA
gtctgaggaaggctcatata

SEQ ID NO: 308478 - DNA, 20 bp, Artificial Sequence
  Description of Artificial Sequence: Synthetic oligonucleotide
  Target: ATXN1; (+) strand; PAM type: YTN; PAM sequence: CTG
aggaaggctcatatactact

SEQ ID NO: 308479 - DNA, 20 bp, Artificial Sequence
  Description of Artificial Sequence: Synthetic oligonucleotide
  Target: ATXN1; (+) strand; PAM type: YTN; PAM sequence: CTC
atatactactggtgagaccc

SEQ ID NO: 308480 - DNA, 20 bp, Artificial Sequence
  Description of Artificial Sequence: Synthetic oligonucleotide
  Target: ATXN1; (+) strand; PAM type: YTN; PAM sequence: CTA
ctggtgagacccacatttca

SEQ ID NO: 308481 - DNA, 20 bp, Artificial Sequence
  Description of Artificial Sequence: Synthetic oligonucleotide
  Target: ATXN1; (+) strand; PAM type: YTN; PAM sequence: CTG
gtgagacccacatttcaagg

SEQ ID NO: 308482 - DNA, 20 bp, Artificial Sequence
  Description of Artificial Sequence: Synthetic oligonucleotide
  Target: ATXN1; (+) strand; PAM type: YTN; PAM sequence: TTT
caaggtcctactcagaaaga

SEQ ID NO: 308483 - DNA, 20 bp, Artificial Sequence
  Description of Artificial Sequence: Synthetic oligonucleotide
  Target: ATXN1; (+) strand; PAM type: YTN; PAM sequence: TTC
aaggtcctactcagaaagac

SEQ ID NO: 308484 - DNA, 20 bp, Artificial Sequence
  Description of Artificial Sequence: Synthetic oligonucleotide
  Target: ATXN1; (+) strand; PAM type: YTN; PAM sequence: CTA
ctcagaaagacgtttcttca

SEQ ID NO: 308485 - DNA, 20 bp, Artificial Sequence
  Description of Artificial Sequence: Synthetic oligonucleotide
  Target: ATXN1; (+) strand; PAM type: YTN; PAM sequence: CTC
agaaagacgtttcttcattt

SEQ ID NO: 308486 - DNA, 20 bp, Artificial Sequence
  Description of Artificial Sequence: Synthetic oligonucleotide
  Target: ATXN1; (+) strand; PAM type: YTN; PAM sequence: TTT
cttcattttaatgttgttta

SEQ ID NO: 308487 - DNA, 20 bp, Artificial Sequence
  Description of Artificial Sequence: Synthetic oligonucleotide
  Target: ATXN1; (+) strand; PAM type: YTN; PAM sequence: TTC
ttcattttaatgttgtttat

SEQ ID NO: 308488 - DNA, 20 bp, Artificial Sequence
  Description of Artificial Sequence: Synthetic oligonucleotide
  Target: ATXN1; (+) strand; PAM type: YTN; PAM sequence: CTT
cattttaatgttgtttatta

SEQ ID NO: 308489 - DNA, 20 bp, Artificial Sequence
  Description of Artificial Sequence: Synthetic oligonucleotide
  Target: ATXN1; (+) strand; PAM type: YTN; PAM sequence: TTC
attttaatgttgtttattac

SEQ ID NO: 308490 - DNA, 20 bp, Artificial Sequence
  Description of Artificial Sequence: Synthetic oligonucleotide
  Target: ATXN1; (+) strand; PAM type: YTN; PAM sequence: TTT
taatgttgtttattactcac

SEQ ID NO: 308491 - DNA, 20 bp, Artificial Sequence
  Description of Artificial Sequence: Synthetic oligonucleotide
  Target: ATXN1; (+) strand; PAM type: YTN; PAM sequence: TTT
aatgttgtttattactcaca

SEQ ID NO: 308492 - DNA, 20 bp, Artificial Sequence
  Description of Artificial Sequence: Synthetic oligonucleotide
  Target: ATXN1; (+) strand; PAM type: YTN; PAM sequence: TTA
atgttgtttattactcacat

SEQ ID NO: 308493 - DNA, 20 bp, Artificial Sequence
  Description of Artificial Sequence: Synthetic oligonucleotide
  Target: ATXN1; (+) strand; PAM type: YTN; PAM sequence: TTG
tttattactcacattctgct

SEQ ID NO: 308494 - DNA, 20 bp, Artificial Sequence
  Description of Artificial Sequence: Synthetic oligonucleotide
  Target: ATXN1; (+) strand; PAM type: YTN; PAM sequence: TTT
attactcacattctgctaat

SEQ ID NO: 308495 - DNA, 20 bp, Artificial Sequence
  Description of Artificial Sequence: Synthetic oligonucleotide
  Target: ATXN1; (+) strand; PAM type: YTN; PAM sequence: TTA
ttactcacattctgctaatc

SEQ ID NO: 308496 - DNA, 20 bp, Artificial Sequence
  Description of Artificial Sequence: Synthetic oligonucleotide
  Target: ATXN1; (+) strand; PAM type: YTN; PAM sequence: TTA
ctcacattctgctaatcact

SEQ ID NO: 308497 - DNA, 20 bp, Artificial Sequence
  Description of Artificial Sequence: Synthetic oligonucleotide
  Target: ATXN1; (+) strand; PAM type: YTN; PAM sequence: CTC
acattctgctaatcactagg

SEQ ID NO: 308498 - DNA, 20 bp, Artificial Sequence
  Description of Artificial Sequence: Synthetic oligonucleotide
  Target: ATXN1; (+) strand; PAM type: YTN; PAM sequence: TTC
tgctaatcactaggatgact

SEQ ID NO: 308499 - DNA, 20 bp, Artificial Sequence
  Description of Artificial Sequence: Synthetic oligonucleotide
  Target: ATXN1; (+) strand; PAM type: YTN; PAM sequence: CTG
ctaatcactaggatgactga

SEQ ID NO: 308500 - DNA, 20 bp, Artificial Sequence
  Description of Artificial Sequence: Synthetic oligonucleotide
  Target: ATXN1; (+) strand; PAM type: YTN; PAM sequence: CTA
atcactaggatgactgaaac

SEQ ID NO: 308501 - DNA, 20 bp, Artificial Sequence
  Description of Artificial Sequence: Synthetic oligonucleotide
  Target: ATXN1; (+) strand; PAM type: YTN; PAM sequence: CTA
ggatgactgaaacagctttg

SEQ ID NO: 308502 - DNA, 20 bp, Artificial Sequence
  Description of Artificial Sequence: Synthetic oligonucleotide
  Target: ATXN1; (+) strand; PAM type: YTN; PAM sequence: CTG
aaacagctttgcagctcgct

SEQ ID NO: 308503 - DNA, 20 bp, Artificial Sequence
  Description of Artificial Sequence: Synthetic oligonucleotide
  Target: ATXN1; (+) strand; PAM type: YTN; PAM sequence: CTT
tgcagctcgctgggaggaaa

SEQ ID NO: 308504 - DNA, 20 bp, Artificial Sequence
  Description of Artificial Sequence: Synthetic oligonucleotide
  Target: ATXN1; (+) strand; PAM type: YTN; PAM sequence: TTT
gcagctcgctgggaggaaaa

SEQ ID NO: 308505 - DNA, 20 bp, Artificial Sequence
  Description of Artificial Sequence: Synthetic oligonucleotide
  Target: ATXN1; (+) strand; PAM type: YTN; PAM sequence: TTG
cagctcgctgggaggaaaat

SEQ ID NO: 308506 - DNA, 20 bp, Artificial Sequence
  Description of Artificial Sequence: Synthetic oligonucleotide
  Target: ATXN1; (+) strand; PAM type: YTN; PAM sequence: CTC
gctgggaggaaaattaaaga

SEQ ID NO: 308507 - DNA, 20 bp, Artificial Sequence
  Description of Artificial Sequence: Synthetic oligonucleotide
  Target: ATXN1; (+) strand; PAM type: YTN; PAM sequence: CTG
ggaggaaaattaaagaaagt

SEQ ID NO: 308508 - DNA, 20 bp, Artificial Sequence
  Description of Artificial Sequence: Synthetic oligonucleotide
  Target: ATXN1; (+) strand; PAM type: YTN; PAM sequence: TTA
aagaaagtagtcttcctcct

SEQ ID NO: 308509 - DNA, 20 bp, Artificial Sequence
  Description of Artificial Sequence: Synthetic oligonucleotide
  Target: ATXN1; (+) strand; PAM type: YTN; PAM sequence: CTT
cctccttttatatctgttta

SEQ ID NO: 308510 - DNA, 20 bp, Artificial Sequence
  Description of Artificial Sequence: Synthetic oligonucleotide
  Target: ATXN1; (+) strand; PAM type: YTN; PAM sequence: TTC
ctccttttatatctgtttac

SEQ ID NO: 308511 - DNA, 20 bp, Artificial Sequence
  Description of Artificial Sequence: Synthetic oligonucleotide
  Target: ATXN1; (+) strand; PAM type: YTN; PAM sequence: CTC
cttttatatctgtttacaca

SEQ ID NO: 308512 - DNA, 20 bp, Artificial Sequence
  Description of Artificial Sequence: Synthetic oligonucleotide
  Target: ATXN1; (+) strand; PAM type: YTN; PAM sequence: CTT
ttatatctgtttacacagat

SEQ ID NO: 308513 - DNA, 20 bp, Artificial Sequence
  Description of Artificial Sequence: Synthetic oligonucleotide
  Target: ATXN1; (+) strand; PAM type: YTN; PAM sequence: TTT
tatatctgtttacacagatt

SEQ ID NO: 308514 - DNA, 20 bp, Artificial Sequence
  Description of Artificial Sequence: Synthetic oligonucleotide
  Target: ATXN1; (+) strand; PAM type: YTN; PAM sequence: TTT
atatctgtttacacagattg

SEQ ID NO: 308515 - DNA, 20 bp, Artificial Sequence
  Description of Artificial Sequence: Synthetic oligonucleotide
  Target: ATXN1; (+) strand; PAM type: YTN; PAM sequence: TTA
tatctgtttacacagattgt

SEQ ID NO: 308516 - DNA, 20 bp, Artificial Sequence
  Description of Artificial Sequence: Synthetic oligonucleotide
  Target: ATXN1; (+) strand; PAM type: YTN; PAM sequence: CTG
tttacacagattgttaaaat

SEQ ID NO: 308517 - DNA, 20 bp, Artificial Sequence
  Description of Artificial Sequence: Synthetic oligonucleotide
  Target: ATXN1; (+) strand; PAM type: YTN; PAM sequence: TTT
acacagattgttaaaatagt

SEQ ID NO: 308518 - DNA, 20 bp, Artificial Sequence
  Description of Artificial Sequence: Synthetic oligonucleotide
  Target: ATXN1; (+) strand; PAM type: YTN; PAM sequence: TTA
cacagattgttaaaatagta

SEQ ID NO: 308519 - DNA, 20 bp, Artificial Sequence
  Description of Artificial Sequence: Synthetic oligonucleotide
  Target: ATXN1; (+) strand; PAM type: YTN; PAM sequence: TTG
ttaaaatagtacggttcatt

SEQ ID NO: 308520 - DNA, 20 bp, Artificial Sequence
  Description of Artificial Sequence: Synthetic oligonucleotide
  Target: ATXN1; (+) strand; PAM type: YTN; PAM sequence: TTA
aaatagtacggttcatttgg

SEQ ID NO: 308521 - DNA, 20 bp, Artificial Sequence
  Description of Artificial Sequence: Synthetic oligonucleotide
  Target: ATXN1; (+) strand; PAM type: YTN; PAM sequence: TTC
atttggacgatgttgagatg

SEQ ID NO: 308522 - DNA, 20 bp, Artificial Sequence
  Description of Artificial Sequence: Synthetic oligonucleotide
  Target: ATXN1; (+) strand; PAM type: YTN; PAM sequence: TTT
ggacgatgttgagatggaaa

SEQ ID NO: 308523 - DNA, 20 bp, Artificial Sequence
  Description of Artificial Sequence: Synthetic oligonucleotide
  Target: ATXN1; (+) strand; PAM type: YTN; PAM sequence: TTG
gacgatgttgagatggaaaa

SEQ ID NO: 308524 - DNA, 20 bp, Artificial Sequence
  Description of Artificial Sequence: Synthetic oligonucleotide
  Target: ATXN1; (+) strand; PAM type: YTN; PAM sequence: TTG
agatggaaaaaaaatataac

SEQ ID NO: 308525 - DNA, 20 bp, Artificial Sequence
  Description of Artificial Sequence: Synthetic oligonucleotide
  Target: ATXN1; (+) strand; PAM type: YTN; PAM sequence: CTT
gttccttctgaagagtagag

SEQ ID NO: 308526 - DNA, 20 bp, Artificial Sequence
  Description of Artificial Sequence: Synthetic oligonucleotide
  Target: ATXN1; (+) strand; PAM type: YTN; PAM sequence: TTG
ttccttctgaagagtagaga

SEQ ID NO: 308527 - DNA, 20 bp, Artificial Sequence
  Description of Artificial Sequence: Synthetic oligonucleotide
  Target: ATXN1; (+) strand; PAM type: YTN; PAM sequence: TTC
cttctgaagagtagagaaag

SEQ ID NO: 308528 - DNA, 20 bp, Artificial Sequence
  Description of Artificial Sequence: Synthetic oligonucleotide
  Target: ATXN1; (+) strand; PAM type: YTN; PAM sequence: CTT
ctgaagagtagagaaaggtt

SEQ ID NO: 308529 - DNA, 20 bp, Artificial Sequence
  Description of Artificial Sequence: Synthetic oligonucleotide
  Target: ATXN1; (+) strand; PAM type: YTN; PAM sequence: TTC
tgaagagtagagaaaggttc

SEQ ID NO: 308530 - DNA, 20 bp, Artificial Sequence
  Description of Artificial Sequence: Synthetic oligonucleotide
  Target: ATXN1; (+) strand; PAM type: YTN; PAM sequence: CTG
aagagtagagaaaggttcaa

SEQ ID NO: 308531 - DNA, 20 bp, Artificial Sequence
  Description of Artificial Sequence: Synthetic oligonucleotide
  Target: ATXN1; (+) strand; PAM type: YTN; PAM sequence: TTC
aaggggttacagaggcttaa

SEQ ID NO: 308532 - DNA, 20 bp, Artificial Sequence
  Description of Artificial Sequence: Synthetic oligonucleotide
  Target: ATXN1; (+) strand; PAM type: YTN; PAM sequence: TTA
cagaggcttaaacagaacag

SEQ ID NO: 308533 - DNA, 20 bp, Artificial Sequence
  Description of Artificial Sequence: Synthetic oligonucleotide
  Target: ATXN1; (+) strand; PAM type: YTN; PAM sequence: CTT
aaacagaacaggaaagccaa

SEQ ID NO: 308534 - DNA, 20 bp, Artificial Sequence
  Description of Artificial Sequence: Synthetic oligonucleotide
  Target: ATXN1; (+) strand; PAM type: YTN; PAM sequence: TTA
aacagaacaggaaagccaaa

SEQ ID NO: 308535 - DNA, 20 bp, Artificial Sequence
  Description of Artificial Sequence: Synthetic oligonucleotide
  Target: ATXN1; (+) strand; PAM type: YTN; PAM sequence: TTT
gggcttagatgccatcacca

SEQ ID NO: 308536 - DNA, 20 bp, Artificial Sequence
  Description of Artificial Sequence: Synthetic oligonucleotide
  Target: ATXN1; (+) strand; PAM type: YTN; PAM sequence: TTG
ggcttagatgccatcaccat

SEQ ID NO: 308537 - DNA, 20 bp, Artificial Sequence
  Description of Artificial Sequence: Synthetic oligonucleotide
  Target: ATXN1; (+) strand; PAM type: YTN; PAM sequence: CTT
agatgccatcaccatatttc

SEQ ID NO: 308538 - DNA, 20 bp, Artificial Sequence
  Description of Artificial Sequence: Synthetic oligonucleotide
  Target: ATXN1; (+) strand; PAM type: YTN; PAM sequence: TTA
gatgccatcaccatatttcc

SEQ ID NO: 308539 - DNA, 20 bp, Artificial Sequence
  Description of Artificial Sequence: Synthetic oligonucleotide
  Target: ATXN1; (+) strand; PAM type: YTN; PAM sequence: TTT
ccttcaaactcaatagaaag

SEQ ID NO: 308540 - DNA, 20 bp, Artificial Sequence
  Description of Artificial Sequence: Synthetic oligonucleotide
  Target: ATXN1; (+) strand; PAM type: YTN; PAM sequence: TTC
cttcaaactcaatagaaagc

SEQ ID NO: 308541 - DNA, 20 bp, Artificial Sequence
  Description of Artificial Sequence: Synthetic oligonucleotide
  Target: ATXN1; (+) strand; PAM type: YTN; PAM sequence: CTT
caaactcaatagaaagcaaa

SEQ ID NO: 308542 - DNA, 20 bp, Artificial Sequence
  Description of Artificial Sequence: Synthetic oligonucleotide
  Target: ATXN1; (+) strand; PAM type: YTN; PAM sequence: TTC
aaactcaatagaaagcaaag

SEQ ID NO: 308543 - DNA, 20 bp, Artificial Sequence
  Description of Artificial Sequence: Synthetic oligonucleotide
  Target: ATXN1; (+) strand; PAM type: YTN; PAM sequence: CTC
aatagaaagcaaagttgtat

SEQ ID NO: 308544 - DNA, 20 bp, Artificial Sequence
  Description of Artificial Sequence: Synthetic oligonucleotide
  Target: ATXN1; (+) strand; PAM type: YTN; PAM sequence: TTG
tatggaaagagatttttaaa

SEQ ID NO: 308545 - DNA, 20 bp, Artificial Sequence
  Description of Artificial Sequence: Synthetic oligonucleotide
  Target: ATXN1; (+) strand; PAM type: YTN; PAM sequence: TTT
ttaaataaataaccatggca

SEQ ID NO: 308546 - DNA, 20 bp, Artificial Sequence
  Description of Artificial Sequence: Synthetic oligonucleotide
  Target: ATXN1; (+) strand; PAM type: YTN; PAM sequence: TTT
taaataaataaccatggcat

SEQ ID NO: 308547 - DNA, 20 bp, Artificial Sequence
  Description of Artificial Sequence: Synthetic oligonucleotide
  Target: ATXN1; (+) strand; PAM type: YTN; PAM sequence: TTT
aaataaataaccatggcatt

SEQ ID NO: 308548 - DNA, 20 bp, Artificial Sequence
  Description of Artificial Sequence: Synthetic oligonucleotide
  Target: ATXN1; (+) strand; PAM type: YTN; PAM sequence: TTA
aataaataaccatggcattt

SEQ ID NO: 308549 - DNA, 20 bp, Artificial Sequence
  Description of Artificial Sequence: Synthetic oligonucleotide
  Target: ATXN1; (+) strand; PAM type: YTN; PAM sequence: TTT
ttttcttctgtcaatacaat

SEQ ID NO: 308550 - DNA, 20 bp, Artificial Sequence
  Description of Artificial Sequence: Synthetic oligonucleotide
  Target: ATXN1; (+) strand; PAM type: YTN; PAM sequence: TTT
tttcttctgtcaatacaata

SEQ ID NO: 308551 - DNA, 20 bp, Artificial Sequence
  Description of Artificial Sequence: Synthetic oligonucleotide
  Target: ATXN1; (+) strand; PAM type: YTN; PAM sequence: TTT
ttcttctgtcaatacaataa

SEQ ID NO: 308552 - DNA, 20 bp, Artificial Sequence
  Description of Artificial Sequence: Synthetic oligonucleotide
  Target: ATXN1; (+) strand; PAM type: YTN; PAM sequence: TTT
tcttctgtcaatacaataat

SEQ ID NO: 308553 - DNA, 20 bp, Artificial Sequence
  Description of Artificial Sequence: Synthetic oligonucleotide
  Target: ATXN1; (+) strand; PAM type: YTN; PAM sequence: TTT
cttctgtcaatacaataata

SEQ ID NO: 308554 - DNA, 20 bp, Artificial Sequence
  Description of Artificial Sequence: Synthetic oligonucleotide
  Target: ATXN1; (+) strand; PAM type: YTN; PAM sequence: TTC
ttctgtcaatacaataataa

SEQ ID NO: 308555 - DNA, 20 bp, Artificial Sequence
  Description of Artificial Sequence: Synthetic oligonucleotide
  Target: ATXN1; (+) strand; PAM type: YTN; PAM sequence: CTT
ctgtcaatacaataataaac

SEQ ID NO: 308556 - DNA, 20 bp, Artificial Sequence
  Description of Artificial Sequence: Synthetic oligonucleotide
  Target: ATXN1; (+) strand; PAM type: YTN; PAM sequence: TTC
tgtcaatacaataataaact

SEQ ID NO: 308557 - DNA, 20 bp, Artificial Sequence
  Description of Artificial Sequence: Synthetic oligonucleotide
  Target: ATXN1; (+) strand; PAM type: YTN; PAM sequence: CTG
tcaatacaataataaacttg

SEQ ID NO: 308558 - DNA, 20 bp, Artificial Sequence
  Description of Artificial Sequence: Synthetic oligonucleotide
  Target: ATXN1; (+) strand; PAM type: YTN; PAM sequence: CTT
gtcttatgggtctatgacca

SEQ ID NO: 308559 - DNA, 20 bp, Artificial Sequence
  Description of Artificial Sequence: Synthetic oligonucleotide
  Target: ATXN1; (+) strand; PAM type: YTN; PAM sequence: TTG
tcttatgggtctatgaccac

SEQ ID NO: 308560 - DNA, 20 bp, Artificial Sequence
  Description of Artificial Sequence: Synthetic oligonucleotide
  Target: ATXN1; (+) strand; PAM type: YTN; PAM sequence: CTT
atgggtctatgaccacttac

SEQ ID NO: 308561 - DNA, 20 bp, Artificial Sequence
  Description of Artificial Sequence: Synthetic oligonucleotide
  Target: ATXN1; (+) strand; PAM type: YTN; PAM sequence: TTA
tgggtctatgaccacttaca

SEQ ID NO: 308562 - DNA, 20 bp, Artificial Sequence
  Description of Artificial Sequence: Synthetic oligonucleotide
  Target: ATXN1; (+) strand; PAM type: YTN; PAM sequence: CTA
tgaccacttacaaaagaaaa

SEQ ID NO: 308563 - DNA, 20 bp, Artificial Sequence
  Description of Artificial Sequence: Synthetic oligonucleotide
  Target: ATXN1; (+) strand; PAM type: YTN; PAM sequence: CTT
acaaaagaaaaaaaaaatcc

SEQ ID NO: 308564 - DNA, 20 bp, Artificial Sequence
  Description of Artificial Sequence: Synthetic oligonucleotide
  Target: ATXN1; (+) strand; PAM type: YTN; PAM sequence: TTA
caaaagaaaaaaaaaatcca

SEQ ID NO: 308565 - DNA, 20 bp, Artificial Sequence
  Description of Artificial Sequence: Synthetic oligonucleotide
  Target: ATXN1; (+) strand; PAM type: YTN; PAM sequence: CTG
ctatcttttgaaaagtatca

SEQ ID NO: 308566 - DNA, 20 bp, Artificial Sequence
  Description of Artificial Sequence: Synthetic oligonucleotide
  Target: ATXN1; (+) strand; PAM type: YTN; PAM sequence: CTA
tcttttgaaaagtatcagat

SEQ ID NO: 308567 - DNA, 20 bp, Artificial Sequence
  Description of Artificial Sequence: Synthetic oligonucleotide
  Target: ATXN1; (+) strand; PAM type: YTN; PAM sequence: CTT
ttgaaaagtatcagatcaga

SEQ ID NO: 308568 - DNA, 20 bp, Artificial Sequence
  Description of Artificial Sequence: Synthetic oligonucleotide
  Target: ATXN1; (+) strand; PAM type: YTN; PAM sequence: TTT
tgaaaagtatcagatcagac

SEQ ID NO: 308569 - DNA, 20 bp, Artificial Sequence
  Description of Artificial Sequence: Synthetic oligonucleotide
  Target: ATXN1; (+) strand; PAM type: YTN; PAM sequence: TTT
gaaaagtatcagatcagaca

SEQ ID NO: 308570 - DNA, 20 bp, Artificial Sequence
  Description of Artificial Sequence: Synthetic oligonucleotide
  Target: ATXN1; (+) strand; PAM type: YTN; PAM sequence: TTG
aaaagtatcagatcagacac

SEQ ID NO: 308571 - DNA, 20 bp, Artificial Sequence
  Description of Artificial Sequence: Synthetic oligonucleotide
  Target: ATXN1; (+) strand; PAM type: YTN; PAM sequence: CTG
gggaacacattctttcccac

SEQ ID NO: 308572 - DNA, 20 bp, Artificial Sequence
  Description of Artificial Sequence: Synthetic oligonucleotide
  Target: ATXN1; (+) strand; PAM type: YTN; PAM sequence: TTC
tttcccacttccttagatga

SEQ ID NO: 308573 - DNA, 20 bp, Artificial Sequence
  Description of Artificial Sequence: Synthetic oligonucleotide
  Target: ATXN1; (+) strand; PAM type: YTN; PAM sequence: CTT
tcccacttccttagatgaag

SEQ ID NO: 308574 - DNA, 20 bp, Artificial Sequence
  Description of Artificial Sequence: Synthetic oligonucleotide
  Target: ATXN1; (+) strand; PAM type: YTN; PAM sequence: TTT
cccacttccttagatgaagg

SEQ ID NO: 308575 - DNA, 20 bp, Artificial Sequence
  Description of Artificial Sequence: Synthetic oligonucleotide
  Target: ATXN1; (+) strand; PAM type: YTN; PAM sequence: TTC
ccacttccttagatgaaggc

SEQ ID NO: 308576 - DNA, 20 bp, Artificial Sequence
  Description of Artificial Sequence: Synthetic oligonucleotide
  Target: ATXN1; (+) strand; PAM type: YTN; PAM sequence: CTT
ccttagatgaaggctgtctc

SEQ ID NO: 308577 - DNA, 20 bp, Artificial Sequence
  Description of Artificial Sequence: Synthetic oligonucleotide
  Target: ATXN1; (+) strand; PAM type: YTN; PAM sequence: TTC
cttagatgaaggctgtctcc

SEQ ID NO: 308578 - DNA, 20 bp, Artificial Sequence
  Description of Artificial Sequence: Synthetic oligonucleotide
  Target: ATXN1; (+) strand; PAM type: YTN; PAM sequence: CTT
agatgaaggctgtctcccaa

SEQ ID NO: 308579 - DNA, 20 bp, Artificial Sequence
  Description of Artificial Sequence: Synthetic oligonucleotide
  Target: ATXN1; (+) strand; PAM type: YTN; PAM sequence: TTA
gatgaaggctgtctcccaat

SEQ ID NO: 308580 - DNA, 20 bp, Artificial Sequence
  Description of Artificial Sequence: Synthetic oligonucleotide
  Target: ATXN1; (+) strand; PAM type: YTN; PAM sequence: CTG
tctcccaataaaagccacaa

SEQ ID NO: 308581 - DNA, 20 bp, Artificial Sequence
  Description of Artificial Sequence: Synthetic oligonucleotide
  Target: ATXN1; (+) strand; PAM type: YTN; PAM sequence: CTC
ccaataaaagccacaacttg

SEQ ID NO: 308582 - DNA, 20 bp, Artificial Sequence
  Description of Artificial Sequence: Synthetic oligonucleotide
  Target: ATXN1; (+) strand; PAM type: YTN; PAM sequence: CTT
ggggtcatacttctctctag

SEQ ID NO: 308583 - DNA, 20 bp, Artificial Sequence
  Description of Artificial Sequence: Synthetic oligonucleotide
  Target: ATXN1; (+) strand; PAM type: YTN; PAM sequence: TTG
gggtcatacttctctctagt

SEQ ID NO: 308584 - DNA, 20 bp, Artificial Sequence
  Description of Artificial Sequence: Synthetic oligonucleotide
  Target: ATXN1; (+) strand; PAM type: YTN; PAM sequence: CTT
ctctctagtctgggttgcag

SEQ ID NO: 308585 - DNA, 20 bp, Artificial Sequence
  Description of Artificial Sequence: Synthetic oligonucleotide
  Target: ATXN1; (+) strand; PAM type: YTN; PAM sequence: TTC
tctctagtctgggttgcagt

SEQ ID NO: 308586 - DNA, 20 bp, Artificial Sequence
  Description of Artificial Sequence: Synthetic oligonucleotide
  Target: ATXN1; (+) strand; PAM type: YTN; PAM sequence: CTC
tctagtctgggttgcagtga

SEQ ID NO: 308587 - DNA, 20 bp, Artificial Sequence
  Description of Artificial Sequence: Synthetic oligonucleotide
  Target: ATXN1; (+) strand; PAM type: YTN; PAM sequence: CTC
tagtctgggttgcagtgacc

SEQ ID NO: 308588 - DNA, 20 bp, Artificial Sequence
  Description of Artificial Sequence: Synthetic oligonucleotide
  Target: ATXN1; (+) strand; PAM type: YTN; PAM sequence: CTA
gtctgggttgcagtgaccca

SEQ ID NO: 308589 - DNA, 20 bp, Artificial Sequence
  Description of Artificial Sequence: Synthetic oligonucleotide
  Target: ATXN1; (+) strand; PAM type: YTN; PAM sequence: CTG
ggttgcagtgacccaggcag

SEQ ID NO: 308590 - DNA, 20 bp, Artificial Sequence
  Description of Artificial Sequence: Synthetic oligonucleotide
  Target: ATXN1; (+) strand; PAM type: YTN; PAM sequence: TTG
cagtgacccaggcagctcca

SEQ ID NO: 308591 - DNA, 20 bp, Artificial Sequence
  Description of Artificial Sequence: Synthetic oligonucleotide
  Target: ATXN1; (+) strand; PAM type: YTN; PAM sequence: CTC
cagaggtgaactggacacag

SEQ ID NO: 308592 - DNA, 20 bp, Artificial Sequence
  Description of Artificial Sequence: Synthetic oligonucleotide
  Target: ATXN1; (+) strand; PAM type: YTN; PAM sequence: CTG
gacacagagcctggaaaagg

SEQ ID NO: 308593 - DNA, 20 bp, Artificial Sequence
  Description of Artificial Sequence: Synthetic oligonucleotide
  Target: ATXN1; (+) strand; PAM type: YTN; PAM sequence: CTG
gaaaaggggaagaataatca

SEQ ID NO: 308594 - DNA, 20 bp, Artificial Sequence
  Description of Artificial Sequence: Synthetic oligonucleotide
  Target: ATXN1; (+) strand; PAM type: YTN; PAM sequence: TTC
atccagagtcatttctgcct

SEQ ID NO: 308595 - DNA, 20 bp, Artificial Sequence
  Description of Artificial Sequence: Synthetic oligonucleotide
  Target: ATXN1; (+) strand; PAM type: YTN; PAM sequence: TTT
ctgcctccccttggaacctg

SEQ ID NO: 308596 - DNA, 20 bp, Artificial Sequence
  Description of Artificial Sequence: Synthetic oligonucleotide
  Target: ATXN1; (+) strand; PAM type: YTN; PAM sequence: TTC
tgcctccccttggaacctgc

SEQ ID NO: 308597 - DNA, 20 bp, Artificial Sequence
  Description of Artificial Sequence: Synthetic oligonucleotide
  Target: ATXN1; (+) strand; PAM type: YTN; PAM sequence: CTG
cctccccttggaacctgcca

SEQ ID NO: 308598 - DNA, 20 bp, Artificial Sequence
  Description of Artificial Sequence: Synthetic oligonucleotide
  Target: ATXN1; (+) strand; PAM type: YTN; PAM sequence: CTC
cccttggaacctgccagggc

SEQ ID NO: 308599 - DNA, 20 bp, Artificial Sequence
  Description of Artificial Sequence: Synthetic oligonucleotide
  Target: ATXN1; (+) strand; PAM type: YTN; PAM sequence: CTT
ggaacctgccagggcagggc

SEQ ID NO: 308600 - DNA, 20 bp, Artificial Sequence
  Description of Artificial Sequence: Synthetic oligonucleotide
  Target: ATXN1; (+) strand; PAM type: YTN; PAM sequence: TTG
gaacctgccagggcagggca

SEQ ID NO: 308601 - DNA, 20 bp, Artificial Sequence
  Description of Artificial Sequence: Synthetic oligonucleotide
  Target: ATXN1; (+) strand; PAM type: YTN; PAM sequence: CTG
ccagggcagggcaaggttaa

SEQ ID NO: 308602 - DNA, 20 bp, Artificial Sequence
  Description of Artificial Sequence: Synthetic oligonucleotide
  Target: ATXN1; (+) strand; PAM type: YTN; PAM sequence: TTA
aaagggccttagggtactct

SEQ ID NO: 308603 - DNA, 20 bp, Artificial Sequence
  Description of Artificial Sequence: Synthetic oligonucleotide
  Target: ATXN1; (+) strand; PAM type: YTN; PAM sequence: CTT
agggtactctcctctggggg

SEQ ID NO: 308604 - DNA, 20 bp, Artificial Sequence
  Description of Artificial Sequence: Synthetic oligonucleotide
  Target: ATXN1; (+) strand; PAM type: YTN; PAM sequence: TTA
gggtactctcctctgggggt

SEQ ID NO: 308605 - DNA, 20 bp, Artificial Sequence
  Description of Artificial Sequence: Synthetic oligonucleotide
  Target: ATXN1; (+) strand; PAM type: YTN; PAM sequence: CTC
tcctctgggggtgctgcagc

SEQ ID NO: 308606 - DNA, 20 bp, Artificial Sequence
  Description of Artificial Sequence: Synthetic oligonucleotide
  Target: ATXN1; (+) strand; PAM type: YTN; PAM sequence: CTC
ctctgggggtgctgcagcgg

SEQ ID NO: 308607 - DNA, 20 bp, Artificial Sequence
  Description of Artificial Sequence: Synthetic oligonucleotide
  Target: ATXN1; (+) strand; PAM type: YTN; PAM sequence: CTC
tgggggtgctgcagcggtca

SEQ ID NO: 308608 - DNA, 20 bp, Artificial Sequence
  Description of Artificial Sequence: Synthetic oligonucleotide
  Target: ATXN1; (+) strand; PAM type: YTN; PAM sequence: CTG
ggggtgctgcagcggtcaaa

SEQ ID NO: 308609 - DNA, 20 bp, Artificial Sequence
  Description of Artificial Sequence: Synthetic oligonucleotide
  Target: ATXN1; (+) strand; PAM type: YTN; PAM sequence: CTG
cagcggtcaaaggacccagg

SEQ ID NO: 308610 - DNA, 20 bp, Artificial Sequence
  Description of Artificial Sequence: Synthetic oligonucleotide
  Target: ATXN1; (+) strand; PAM type: YTN; PAM sequence: CTT
cagtttccaatgggaggcat

SEQ ID NO: 308611 - DNA, 20 bp, Artificial Sequence
  Description of Artificial Sequence: Synthetic oligonucleotide
  Target: ATXN1; (+) strand; PAM type: YTN; PAM sequence: TTC
agtttccaatgggaggcatt

SEQ ID NO: 308612 - DNA, 20 bp, Artificial Sequence
  Description of Artificial Sequence: Synthetic oligonucleotide
  Target: ATXN1; (+) strand; PAM type: YTN; PAM sequence: TTT
ccaatgggaggcatttccat

SEQ ID NO: 308613 - DNA, 20 bp, Artificial Sequence
  Description of Artificial Sequence: Synthetic oligonucleotide
  Target: ATXN1; (+) strand; PAM type: YTN; PAM sequence: TTC
caatgggaggcatttccata

SEQ ID NO: 308614 - DNA, 20 bp, Artificial Sequence
  Description of Artificial Sequence: Synthetic oligonucleotide
  Target: ATXN1; (+) strand; PAM type: YTN; PAM sequence: TTT
ccatacctgtcagaatctct

SEQ ID NO: 308615 - DNA, 20 bp, Artificial Sequence
  Description of Artificial Sequence: Synthetic oligonucleotide
  Target: ATXN1; (+) strand; PAM type: YTN; PAM sequence: TTC
catacctgtcagaatctctt

SEQ ID NO: 308616 - DNA, 20 bp, Artificial Sequence
  Description of Artificial Sequence: Synthetic oligonucleotide
  Target: ATXN1; (+) strand; PAM type: YTN; PAM sequence: CTG
tcagaatctcttaacaggtt

SEQ ID NO: 308617 - DNA, 20 bp, Artificial Sequence
  Description of Artificial Sequence: Synthetic oligonucleotide
  Target: ATXN1; (+) strand; PAM type: YTN; PAM sequence: CTC
ttaacaggttctgacatatg

SEQ ID NO: 308618 - DNA, 20 bp, Artificial Sequence
  Description of Artificial Sequence: Synthetic oligonucleotide
  Target: ATXN1; (+) strand; PAM type: YTN; PAM sequence: CTT
aacaggttctgacatatggt

SEQ ID NO: 308619 - DNA, 20 bp, Artificial Sequence
  Description of Artificial Sequence: Synthetic oligonucleotide
  Target: ATXN1; (+) strand; PAM type: YTN; PAM sequence: TTA
acaggttctgacatatggtc

SEQ ID NO: 308620 - DNA, 20 bp, Artificial Sequence
  Description of Artificial Sequence: Synthetic oligonucleotide
  Target: ATXN1; (+) strand; PAM type: YTN; PAM sequence: TTC
tgacatatggtccaacatat

SEQ ID NO: 308621 - DNA, 20 bp, Artificial Sequence
  Description of Artificial Sequence: Synthetic oligonucleotide
  Target: ATXN1; (+) strand; PAM type: YTN; PAM sequence: CTG
acatatggtccaacatatgg

SEQ ID NO: 308622 - DNA, 20 bp, Artificial Sequence
  Description of Artificial Sequence: Synthetic oligonucleotide
  Target: ATXN1; (+) strand; PAM type: YTN; PAM sequence: CTC
acaccatcaaccacaaatgc

SEQ ID NO: 308623 - DNA, 20 bp, Artificial Sequence
  Description of Artificial Sequence: Synthetic oligonucleotide
  Target: ATXN1; (+) strand; PAM type: YTN; PAM sequence: CTC
cctccacctggagaaggcgt

SEQ ID NO: 308624 - DNA, 20 bp, Artificial Sequence
  Description of Artificial Sequence: Synthetic oligonucleotide
  Target: ATXN1; (+) strand; PAM type: YTN; PAM sequence: CTC
cacctggagaaggcgtcctc

SEQ ID NO: 308625 - DNA, 20 bp, Artificial Sequence
  Description of Artificial Sequence: Synthetic oligonucleotide
  Target: ATXN1; (+) strand; PAM type: YTN; PAM sequence: CTG
gagaaggcgtcctcacctac

SEQ ID NO: 308626 - DNA, 20 bp, Artificial Sequence
  Description of Artificial Sequence: Synthetic oligonucleotide
  Target: ATXN1; (+) strand; PAM type: YTN; PAM sequence: CTC
acctaccaccaacagtgcaa

SEQ ID NO: 308627 - DNA, 20 bp, Artificial Sequence
  Description of Artificial Sequence: Synthetic oligonucleotide
  Target: ATXN1; (+) strand; PAM type: YTN; PAM sequence: CTA
ccaccaacagtgcaacttcg

SEQ ID NO: 308628 - DNA, 20 bp, Artificial Sequence
  Description of Artificial Sequence: Synthetic oligonucleotide
  Target: ATXN1; (+) strand; PAM type: YTN; PAM sequence: CTT
cgagatgaagtcatttacaa

SEQ ID NO: 308629 - DNA, 20 bp, Artificial Sequence
  Description of Artificial Sequence: Synthetic oligonucleotide
  Target: ATXN1; (+) strand; PAM type: YTN; PAM sequence: TTC
gagatgaagtcatttacaac

SEQ ID NO: 308630 - DNA, 20 bp, Artificial Sequence
  Description of Artificial Sequence: Synthetic oligonucleotide
  Target: ATXN1; (+) strand; PAM type: YTN; PAM sequence: TTT
acaacccagaggagatggat

SEQ ID NO: 308631 - DNA, 20 bp, Artificial Sequence
  Description of Artificial Sequence: Synthetic oligonucleotide
  Target: ATXN1; (+) strand; PAM type: YTN; PAM sequence: TTA
caacccagaggagatggatg

SEQ ID NO: 308632 - DNA, 20 bp, Artificial Sequence
  Description of Artificial Sequence: Synthetic oligonucleotide
  Target: ATXN1; (+) strand; PAM type: YTN; PAM sequence: CTC
aaaagggcacagataagatt

SEQ ID NO: 308633 - DNA, 20 bp, Artificial Sequence
  Description of Artificial Sequence: Synthetic oligonucleotide
  Target: ATXN1; (+) strand; PAM type: YTN; PAM sequence: TTA
gatggacctcctaccccacc

SEQ ID NO: 308634 - DNA, 20 bp, Artificial Sequence
  Description of Artificial Sequence: Synthetic oligonucleotide
  Target: ATXN1; (+) strand; PAM type: YTN; PAM sequence: CTC
ctaccccaccggtttcatac

SEQ ID NO: 308635 - DNA, 20 bp, Artificial Sequence
  Description of Artificial Sequence: Synthetic oligonucleotide
  Target: ATXN1; (+) strand; PAM type: YTN; PAM sequence: CTA
ccccaccggtttcatacttg

SEQ ID NO: 308636 - DNA, 20 bp, Artificial Sequence
  Description of Artificial Sequence: Synthetic oligonucleotide
  Target: ATXN1; (+) strand; PAM type: YTN; PAM sequence: TTT
catacttgacgagcagggtt

SEQ ID NO: 308637 - DNA, 20 bp, Artificial Sequence
  Description of Artificial Sequence: Synthetic oligonucleotide
  Target: ATXN1; (+) strand; PAM type: YTN; PAM sequence: TTC
atacttgacgagcagggttt

SEQ ID NO: 308638 - DNA, 20 bp, Artificial Sequence
  Description of Artificial Sequence: Synthetic oligonucleotide
  Target: ATXN1; (+) strand; PAM type: YTN; PAM sequence: CTT
gacgagcagggtttgcagaa

SEQ ID NO: 308639 - DNA, 20 bp, Artificial Sequence
  Description of Artificial Sequence: Synthetic oligonucleotide
  Target: ATXN1; (+) strand; PAM type: YTN; PAM sequence: TTG
acgagcagggtttgcagaag

SEQ ID NO: 308640 - DNA, 20 bp, Artificial Sequence
  Description of Artificial Sequence: Synthetic oligonucleotide
  Target: ATXN1; (+) strand; PAM type: YTN; PAM sequence: TTT
gcagaagaaggtttcatggt

SEQ ID NO: 308641 - DNA, 20 bp, Artificial Sequence
  Description of Artificial Sequence: Synthetic oligonucleotide
  Target: ATXN1; (+) strand; PAM type: YTN; PAM sequence: TTG
cagaagaaggtttcatggtc

SEQ ID NO: 308642 - DNA, 20 bp, Artificial Sequence
  Description of Artificial Sequence: Synthetic oligonucleotide
  Target: ATXN1; (+) strand; PAM type: YTN; PAM sequence: TTT
catggtcaccctaccccttt

SEQ ID NO: 308643 - DNA, 20 bp, Artificial Sequence
  Description of Artificial Sequence: Synthetic oligonucleotide
  Target: ATXN1; (+) strand; PAM type: YTN; PAM sequence: TTC
atggtcaccctaccccttta

SEQ ID NO: 308644 - DNA, 20 bp, Artificial Sequence
  Description of Artificial Sequence: Synthetic oligonucleotide
  Target: ATXN1; (+) strand; PAM type: YTN; PAM sequence: CTA
cccctttaagcagttctcct

SEQ ID NO: 308645 - DNA, 20 bp, Artificial Sequence
  Description of Artificial Sequence: Synthetic oligonucleotide
  Target: ATXN1; (+) strand; PAM type: YTN; PAM sequence: CTT
taagcagttctcctttccat

SEQ ID NO: 308646 - DNA, 20 bp, Artificial Sequence
  Description of Artificial Sequence: Synthetic oligonucleotide
  Target: ATXN1; (+) strand; PAM type: YTN; PAM sequence: TTT
aagcagttctcctttccatg

SEQ ID NO: 308647 - DNA, 20 bp, Artificial Sequence
  Description of Artificial Sequence: Synthetic oligonucleotide
  Target: ATXN1; (+) strand; PAM type: YTN; PAM sequence: TTA
agcagttctcctttccatgt

SEQ ID NO: 308648 - DNA, 20 bp, Artificial Sequence
  Description of Artificial Sequence: Synthetic oligonucleotide
  Target: ATXN1; (+) strand; PAM type: YTN; PAM sequence: TTC
tcctttccatgtggtacctt

SEQ ID NO: 308649 - DNA, 20 bp, Artificial Sequence
  Description of Artificial Sequence: Synthetic oligonucleotide
  Target: ATXN1; (+) strand; PAM type: YTN; PAM sequence: CTC
ctttccatgtggtaccttaa

SEQ ID NO: 308650 - DNA, 20 bp, Artificial Sequence
  Description of Artificial Sequence: Synthetic oligonucleotide
  Target: ATXN1; (+) strand; PAM type: YTN; PAM sequence: CTT
tccatgtggtaccttaacct

SEQ ID NO: 308651 - DNA, 20 bp, Artificial Sequence
  Description of Artificial Sequence: Synthetic oligonucleotide
  Target: ATXN1; (+) strand; PAM type: YTN; PAM sequence: TTT
ccatgtggtaccttaaccta

SEQ ID NO: 308652 - DNA, 20 bp, Artificial Sequence
  Description of Artificial Sequence: Synthetic oligonucleotide
  Target: ATXN1; (+) strand; PAM type: YTN; PAM sequence: TTC
catgtggtaccttaacctaa

SEQ ID NO: 308653 - DNA, 20 bp, Artificial Sequence
  Description of Artificial Sequence: Synthetic oligonucleotide
  Target: ATXN1; (+) strand; PAM type: YTN; PAM sequence: CTT
aacctaaatctaaccaacca

SEQ ID NO: 308654 - DNA, 20 bp, Artificial Sequence
  Description of Artificial Sequence: Synthetic oligonucleotide
  Target: ATXN1; (+) strand; PAM type: YTN; PAM sequence: TTA
acctaaatctaaccaaccaa

SEQ ID NO: 308655 - DNA, 20 bp, Artificial Sequence
  Description of Artificial Sequence: Synthetic oligonucleotide
  Target: ATXN1; (+) strand; PAM type: YTN; PAM sequence: CTA
aatctaaccaaccaacctca

SEQ ID NO: 308656 - DNA, 20 bp, Artificial Sequence
  Description of Artificial Sequence: Synthetic oligonucleotide
  Target: ATXN1; (+) strand; PAM type: YTN; PAM sequence: CTA
accaaccaacctcacttaga

SEQ ID NO: 308657 - DNA, 20 bp, Artificial Sequence
  Description of Artificial Sequence: Synthetic oligonucleotide
  Target: ATXN1; (+) strand; PAM type: YTN; PAM sequence: CTC
acttagaacttcagaactac

SEQ ID NO: 308658 - DNA, 20 bp, Artificial Sequence
  Description of Artificial Sequence: Synthetic oligonucleotide
  Target: ATXN1; (+) strand; PAM type: YTN; PAM sequence: CTT
agaacttcagaactactctc

SEQ ID NO: 308659 - DNA, 20 bp, Artificial Sequence
  Description of Artificial Sequence: Synthetic oligonucleotide
  Target: ATXN1; (+) strand; PAM type: YTN; PAM sequence: TTA
gaacttcagaactactctct

SEQ ID NO: 308660 - DNA, 20 bp, Artificial Sequence
  Description of Artificial Sequence: Synthetic oligonucleotide
  Target: ATXN1; (+) strand; PAM type: YTN; PAM sequence: CTT
cagaactactctcttccaga

SEQ ID NO: 308661 - DNA, 20 bp, Artificial Sequence
  Description of Artificial Sequence: Synthetic oligonucleotide
  Target: ATXN1; (+) strand; PAM type: YTN; PAM sequence: TTC
agaactactctcttccagat

SEQ ID NO: 308662 - DNA, 20 bp, Artificial Sequence
  Description of Artificial Sequence: Synthetic oligonucleotide
  Target: ATXN1; (+) strand; PAM type: YTN; PAM sequence: CTA
ctctcttccagataaaagta

SEQ ID NO: 308663 - DNA, 20 bp, Artificial Sequence
  Description of Artificial Sequence: Synthetic oligonucleotide
  Target: ATXN1; (+) strand; PAM type: YTN; PAM sequence: CTC
tcttccagataaaagtatct

SEQ ID NO: 308664 - DNA, 20 bp, Artificial Sequence
  Description of Artificial Sequence: Synthetic oligonucleotide
  Target: ATXN1; (+) strand; PAM type: YTN; PAM sequence: CTC
ttccagataaaagtatctcc

SEQ ID NO: 308665 - DNA, 20 bp, Artificial Sequence
  Description of Artificial Sequence: Synthetic oligonucleotide
  Target: ATXN1; (+) strand; PAM type: YTN; PAM sequence: CTT
ccagataaaagtatctcctt

SEQ ID NO: 308666 - DNA, 20 bp, Artificial Sequence
  Description of Artificial Sequence: Synthetic oligonucleotide
  Target: ATXN1; (+) strand; PAM type: YTN; PAM sequence: TTC
cagataaaagtatctccttg

SEQ ID NO: 308667 - DNA, 20 bp, Artificial Sequence
  Description of Artificial Sequence: Synthetic oligonucleotide
  Target: ATXN1; (+) strand; PAM type: YTN; PAM sequence: CTC
cttgggataactatctcact

SEQ ID NO: 308668 - DNA, 20 bp, Artificial Sequence
  Description of Artificial Sequence: Synthetic oligonucleotide
  Target: ATXN1; (+) strand; PAM type: YTN; PAM sequence: CTT
gggataactatctcactaga

SEQ ID NO: 308669 - DNA, 20 bp, Artificial Sequence
  Description of Artificial Sequence: Synthetic oligonucleotide
  Target: ATXN1; (+) strand; PAM type: YTN; PAM sequence: TTG
ggataactatctcactagaa

SEQ ID NO: 308670 - DNA, 20 bp, Artificial Sequence
  Description of Artificial Sequence: Synthetic oligonucleotide
  Target: ATXN1; (+) strand; PAM type: YTN; PAM sequence: CTA
tctcactagaaactttcacc

SEQ ID NO: 308671 - DNA, 20 bp, Artificial Sequence
  Description of Artificial Sequence: Synthetic oligonucleotide
  Target: ATXN1; (+) strand; PAM type: YTN; PAM sequence: CTC
actagaaactttcacctgag

SEQ ID NO: 308672 - DNA, 20 bp, Artificial Sequence
  Description of Artificial Sequence: Synthetic oligonucleotide
  Target: ATXN1; (+) strand; PAM type: YTN; PAM sequence: CTA
gaaactttcacctgagttgc

SEQ ID NO: 308673 - DNA, 20 bp, Artificial Sequence
  Description of Artificial Sequence: Synthetic oligonucleotide
  Target: ATXN1; (+) strand; PAM type: YTN; PAM sequence: CTT
tcacctgagttgcagagtat

SEQ ID NO: 308674 - DNA, 20 bp, Artificial Sequence
  Description of Artificial Sequence: Synthetic oligonucleotide
  Target: ATXN1; (+) strand; PAM type: YTN; PAM sequence: TTT
cacctgagttgcagagtatg

SEQ ID NO: 308675 - DNA, 20 bp, Artificial Sequence
  Description of Artificial Sequence: Synthetic oligonucleotide
  Target: ATXN1; (+) strand; PAM type: YTN; PAM sequence: TTC
acctgagttgcagagtatga

SEQ ID NO: 308676 - DNA, 20 bp, Artificial Sequence
  Description of Artificial Sequence: Synthetic oligonucleotide
  Target: ATXN1; (+) strand; PAM type: YTN; PAM sequence: CTG
agttgcagagtatgaccacg

SEQ ID NO: 308677 - DNA, 20 bp, Artificial Sequence
  Description of Artificial Sequence: Synthetic oligonucleotide
  Target: ATXN1; (+) strand; PAM type: YTN; PAM sequence: TTG
cagagtatgaccacgagagc

SEQ ID NO: 308678 - DNA, 20 bp, Artificial Sequence
  Description of Artificial Sequence: Synthetic oligonucleotide
  Target: ATXN1; (+) strand; PAM type: YTN; PAM sequence: CTT
aaaggagactgatcaaagtc

SEQ ID NO: 308679 - DNA, 20 bp, Artificial Sequence
  Description of Artificial Sequence: Synthetic oligonucleotide
  Target: ATXN1; (+) strand; PAM type: YTN; PAM sequence: TTA
aaggagactgatcaaagtca

SEQ ID NO: 308680 - DNA, 20 bp, Artificial Sequence
  Description of Artificial Sequence: Synthetic oligonucleotide
  Target: ATXN1; (+) strand; PAM type: YTN; PAM sequence: CTG
atcaaagtcagaaaacagat

SEQ ID NO: 308681 - DNA, 20 bp, Artificial Sequence
  Description of Artificial Sequence: Synthetic oligonucleotide
  Target: ATXN1; (+) strand; PAM type: YTN; PAM sequence: TTA
agaacgtgaacctcaaattc

SEQ ID NO: 308682 - DNA, 20 bp, Artificial Sequence
  Description of Artificial Sequence: Synthetic oligonucleotide
  Target: ATXN1; (+) strand; PAM type: YTN; PAM sequence: CTC
aaattcatttattcattcga

SEQ ID NO: 308683 - DNA, 20 bp, Artificial Sequence
  Description of Artificial Sequence: Synthetic oligonucleotide
  Target: ATXN1; (+) strand; PAM type: YTN; PAM sequence: TTC
atttattcattcgatgcaat

SEQ ID NO: 308684 - DNA, 20 bp, Artificial Sequence
  Description of Artificial Sequence: Synthetic oligonucleotide
  Target: ATXN1; (+) strand; PAM type: YTN; PAM sequence: TTT
attcattcgatgcaatagct

SEQ ID NO: 308685 - DNA, 20 bp, Artificial Sequence
  Description of Artificial Sequence: Synthetic oligonucleotide
  Target: ATXN1; (+) strand; PAM type: YTN; PAM sequence: TTA
ttcattcgatgcaatagctg

SEQ ID NO: 308686 - DNA, 20 bp, Artificial Sequence
  Description of Artificial Sequence: Synthetic oligonucleotide
  Target: ATXN1; (+) strand; PAM type: YTN; PAM sequence: TTC
attcgatgcaatagctgcat

SEQ ID NO: 308687 - DNA, 20 bp, Artificial Sequence
  Description of Artificial Sequence: Synthetic oligonucleotide
  Target: ATXN1; (+) strand; PAM type: YTN; PAM sequence: TTC
gatgcaatagctgcatttct

SEQ ID NO: 308688 - DNA, 20 bp, Artificial Sequence
  Description of Artificial Sequence: Synthetic oligonucleotide
  Target: ATXN1; (+) strand; PAM type: YTN; PAM sequence: CTG
catttctaaaaatcttcata

SEQ ID NO: 308689 - DNA, 20 bp, Artificial Sequence
  Description of Artificial Sequence: Synthetic oligonucleotide
  Target: ATXN1; (+) strand; PAM type: YTN; PAM sequence: TTT
ctaaaaatcttcatataatc

SEQ ID NO: 308690 - DNA, 20 bp, Artificial Sequence
  Description of Artificial Sequence: Synthetic oligonucleotide
  Target: ATXN1; (+) strand; PAM type: YTN; PAM sequence: TTC
taaaaatcttcatataatcg

SEQ ID NO: 308691 - DNA, 20 bp, Artificial Sequence
  Description of Artificial Sequence: Synthetic oligonucleotide
  Target: ATXN1; (+) strand; PAM type: YTN; PAM sequence: CTA
aaaatcttcatataatcgaa

SEQ ID NO: 308692 - DNA, 20 bp, Artificial Sequence
  Description of Artificial Sequence: Synthetic oligonucleotide
  Target: ATXN1; (+) strand; PAM type: YTN; PAM sequence: CTT
catataatcgaaattcagta

SEQ ID NO: 308693 - DNA, 20 bp, Artificial Sequence
  Description of Artificial Sequence: Synthetic oligonucleotide
  Target: ATXN1; (+) strand; PAM type: YTN; PAM sequence: TTC
atataatcgaaattcagtag

SEQ ID NO: 308694 - DNA, 20 bp, Artificial Sequence
  Description of Artificial Sequence: Synthetic oligonucleotide
  Target: ATXN1; (+) strand; PAM type: YTN; PAM sequence: TTC
agtaggaattttttcaatga

SEQ ID NO: 308695 - DNA, 20 bp, Artificial Sequence
  Description of Artificial Sequence: Synthetic oligonucleotide
  Target: ATXN1; (+) strand; PAM type: YTN; PAM sequence: TTT
tttcaatgaggaggaagaca

SEQ ID NO: 308696 - DNA, 20 bp, Artificial Sequence
  Description of Artificial Sequence: Synthetic oligonucleotide
  Target: ATXN1; (+) strand; PAM type: YTN; PAM sequence: TTT
ttcaatgaggaggaagacag

SEQ ID NO: 308697 - DNA, 20 bp, Artificial Sequence
  Description of Artificial Sequence: Synthetic oligonucleotide
  Target: ATXN1; (+) strand; PAM type: YTN; PAM sequence: TTT
tcaatgaggaggaagacagt

SEQ ID NO: 308698 - DNA, 20 bp, Artificial Sequence
  Description of Artificial Sequence: Synthetic oligonucleotide
  Target: ATXN1; (+) strand; PAM type: YTN; PAM sequence: TTT
caatgaggaggaagacagtc

SEQ ID NO: 308699 - DNA, 20 bp, Artificial Sequence
  Description of Artificial Sequence: Synthetic oligonucleotide
  Target: ATXN1; (+) strand; PAM type: YTN; PAM sequence: TTC
aatgaggaggaagacagtct

SEQ ID NO: 308700 - DNA, 20 bp, Artificial Sequence
  Description of Artificial Sequence: Synthetic oligonucleotide
  Target: ATXN1; (+) strand; PAM type: YTN; PAM sequence: CTT
agacgttcaaaaacaaaagc

SEQ ID NO: 308701 - DNA, 20 bp, Artificial Sequence
  Description of Artificial Sequence: Synthetic oligonucleotide
  Target: ATXN1; (+) strand; PAM type: YTN; PAM sequence: TTA
gacgttcaaaaacaaaagca

SEQ ID NO: 308702 - DNA, 20 bp, Artificial Sequence
  Description of Artificial Sequence: Synthetic oligonucleotide
  Target: ATXN1; (+) strand; PAM type: YTN; PAM sequence: TTC
aaaaacaaaagcatttttcc

SEQ ID NO: 308703 - DNA, 20 bp, Artificial Sequence
  Description of Artificial Sequence: Synthetic oligonucleotide
  Target: ATXN1; (+) strand; PAM type: YTN; PAM sequence: TTT
ttcctgtattgaatttcaat

SEQ ID NO: 308704 - DNA, 20 bp, Artificial Sequence
  Description of Artificial Sequence: Synthetic oligonucleotide
  Target: ATXN1; (+) strand; PAM type: YTN; PAM sequence: TTT
tcctgtattgaatttcaata

SEQ ID NO: 308705 - DNA, 20 bp, Artificial Sequence
  Description of Artificial Sequence: Synthetic oligonucleotide
  Target: ATXN1; (+) strand; PAM type: YTN; PAM sequence: TTT
cctgtattgaatttcaataa

SEQ ID NO: 308706 - DNA, 20 bp, Artificial Sequence
  Description of Artificial Sequence: Synthetic oligonucleotide
  Target: ATXN1; (+) strand; PAM type: YTN; PAM sequence: TTC
ctgtattgaatttcaataat

SEQ ID NO: 308707 - DNA, 20 bp, Artificial Sequence
  Description of Artificial Sequence: Synthetic oligonucleotide
  Target: ATXN1; (+) strand; PAM type: YTN; PAM sequence: CTG
tattgaatttcaataataat

SEQ ID NO: 308708 - DNA, 20 bp, Artificial Sequence
  Description of Artificial Sequence: Synthetic oligonucleotide
  Target: ATXN1; (+) strand; PAM type: YTN; PAM sequence: TTG
aatttcaataataatagtgt

SEQ ID NO: 308709 - DNA, 20 bp, Artificial Sequence
  Description of Artificial Sequence: Synthetic oligonucleotide
  Target: ATXN1; (+) strand; PAM type: YTN; PAM sequence: TTT
caataataatagtgttttgt

SEQ ID NO: 308710 - DNA, 20 bp, Artificial Sequence
  Description of Artificial Sequence: Synthetic oligonucleotide
  Target: ATXN1; (+) strand; PAM type: YTN; PAM sequence: TTC
aataataatagtgttttgtg

SEQ ID NO: 308711 - DNA, 20 bp, Artificial Sequence
  Description of Artificial Sequence: Synthetic oligonucleotide
  Target: ATXN1; (+) strand; PAM type: YTN; PAM sequence: TTT
tgtgtggttataagtgcagt

SEQ ID NO: 308712 - DNA, 20 bp, Artificial Sequence
  Description of Artificial Sequence: Synthetic oligonucleotide
  Target: ATXN1; (+) strand; PAM type: YTN; PAM sequence: TTT
gtgtggttataagtgcagta

SEQ ID NO: 308713 - DNA, 20 bp, Artificial Sequence
  Description of Artificial Sequence: Synthetic oligonucleotide
  Target: ATXN1; (+) strand; PAM type: YTN; PAM sequence: TTG
tgtggttataagtgcagtac

SEQ ID NO: 308714 - DNA, 20 bp, Artificial Sequence
  Description of Artificial Sequence: Synthetic oligonucleotide
  Target: ATXN1; (+) strand; PAM type: YTN; PAM sequence: TTA
taagtgcagtactataaaac

SEQ ID NO: 308715 - DNA, 20 bp, Artificial Sequence
  Description of Artificial Sequence: Synthetic oligonucleotide
  Target: ATXN1; (+) strand; PAM type: YTN; PAM sequence: CTA
taaaacttaaatatgattga

SEQ ID NO: 308716 - DNA, 20 bp, Artificial Sequence
  Description of Artificial Sequence: Synthetic oligonucleotide
  Target: ATXN1; (+) strand; PAM type: YTN; PAM sequence: CTT
aaatatgattgagcgaattc

SEQ ID NO: 308717 - DNA, 20 bp, Artificial Sequence
  Description of Artificial Sequence: Synthetic oligonucleotide
  Target: ATXN1; (+) strand; PAM type: YTN; PAM sequence: TTA
aatatgattgagcgaattca

SEQ ID NO: 308718 - DNA, 20 bp, Artificial Sequence
  Description of Artificial Sequence: Synthetic oligonucleotide
  Target: ATXN1; (+) strand; PAM type: YTN; PAM sequence: TTG
agcgaattcagcactctatt

SEQ ID NO: 308719 - DNA, 20 bp, Artificial Sequence
  Description of Artificial Sequence: Synthetic oligonucleotide
  Target: ATXN1; (+) strand; PAM type: YTN; PAM sequence: TTC
agcactctattacgtacagc

SEQ ID NO: 308720 - DNA, 20 bp, Artificial Sequence
  Description of Artificial Sequence: Synthetic oligonucleotide
  Target: ATXN1; (+) strand; PAM type: YTN; PAM sequence: CTC
tattacgtacagctttcttt

SEQ ID NO: 308721 - DNA, 20 bp, Artificial Sequence
  Description of Artificial Sequence: Synthetic oligonucleotide
  Target: ATXN1; (+) strand; PAM type: YTN; PAM sequence: CTA
ttacgtacagctttctttcc

SEQ ID NO: 308722 - DNA, 20 bp, Artificial Sequence
  Description of Artificial Sequence: Synthetic oligonucleotide
  Target: ATXN1; (+) strand; PAM type: YTN; PAM sequence: TTA
cgtacagctttctttccaga

SEQ ID NO: 308723 - DNA, 20 bp, Artificial Sequence
  Description of Artificial Sequence: Synthetic oligonucleotide
  Target: ATXN1; (+) strand; PAM type: YTN; PAM sequence: CTT
tctttccagaaaattcatca

SEQ ID NO: 308724 - DNA, 20 bp, Artificial Sequence
  Description of Artificial Sequence: Synthetic oligonucleotide
  Target: ATXN1; (+) strand; PAM type: YTN; PAM sequence: TTT
ctttccagaaaattcatcat

SEQ ID NO: 308725 - DNA, 20 bp, Artificial Sequence
  Description of Artificial Sequence: Synthetic oligonucleotide
  Target: ATXN1; (+) strand; PAM type: YTN; PAM sequence: TTC
tttccagaaaattcatcatt

SEQ ID NO: 308726 - DNA, 20 bp, Artificial Sequence
  Description of Artificial Sequence: Synthetic oligonucleotide
  Target: ATXN1; (+) strand; PAM type: YTN; PAM sequence: CTT
tccagaaaattcatcattgg

SEQ ID NO: 308727 - DNA, 20 bp, Artificial Sequence
  Description of Artificial Sequence: Synthetic oligonucleotide
  Target: ATXN1; (+) strand; PAM type: YTN; PAM sequence: TTT
ccagaaaattcatcattgga

SEQ ID NO: 308728 - DNA, 20 bp, Artificial Sequence
  Description of Artificial Sequence: Synthetic oligonucleotide
  Target: ATXN1; (+) strand; PAM type: YTN; PAM sequence: TTC
cagaaaattcatcattggac

SEQ ID NO: 308729 - DNA, 20 bp, Artificial Sequence
  Description of Artificial Sequence: Synthetic oligonucleotide
  Target: ATXN1; (+) strand; PAM type: YTN; PAM sequence: TTC
atcattggacctttctttct

SEQ ID NO: 308730 - DNA, 20 bp, Artificial Sequence
  Description of Artificial Sequence: Synthetic oligonucleotide
  Target: ATXN1; (+) strand; PAM type: YTN; PAM sequence: TTG
gacctttctttctccttagc

SEQ ID NO: 308731 - DNA, 20 bp, Artificial Sequence
  Description of Artificial Sequence: Synthetic oligonucleotide
  Target: ATXN1; (+) strand; PAM type: YTN; PAM sequence: CTT
tctttctccttagcacaggc

SEQ ID NO: 308732 - DNA, 20 bp, Artificial Sequence
  Description of Artificial Sequence: Synthetic oligonucleotide
  Target: ATXN1; (+) strand; PAM type: YTN; PAM sequence: TTT
ctttctccttagcacaggct

SEQ ID NO: 308733 - DNA, 20 bp, Artificial Sequence
  Description of Artificial Sequence: Synthetic oligonucleotide
  Target: ATXN1; (+) strand; PAM type: YTN; PAM sequence: TTC
tttctccttagcacaggctt

SEQ ID NO: 308734 - DNA, 20 bp, Artificial Sequence
  Description of Artificial Sequence: Synthetic oligonucleotide
  Target: ATXN1; (+) strand; PAM type: YTN; PAM sequence: CTT
tctccttagcacaggcttct

SEQ ID NO: 308735 - DNA, 20 bp, Artificial Sequence
  Description of Artificial Sequence: Synthetic oligonucleotide
  Target: ATXN1; (+) strand; PAM type: YTN; PAM sequence: TTT
ctccttagcacaggcttctt

SEQ ID NO: 308736 - DNA, 20 bp, Artificial Sequence
  Description of Artificial Sequence: Synthetic oligonucleotide
  Target: ATXN1; (+) strand; PAM type: YTN; PAM sequence: TTC
tccttagcacaggcttctta

SEQ ID NO: 308737 - DNA, 20 bp, Artificial Sequence
  Description of Artificial Sequence: Synthetic oligonucleotide
  Target: ATXN1; (+) strand; PAM type: YTN; PAM sequence: CTC
cttagcacaggcttcttaca

SEQ ID NO: 308738 - DNA, 20 bp, Artificial Sequence
  Description of Artificial Sequence: Synthetic oligonucleotide
  Target: ATXN1; (+) strand; PAM type: YTN; PAM sequence: CTT
agcacaggcttcttacacat

SEQ ID NO: 308739 - DNA, 20 bp, Artificial Sequence
  Description of Artificial Sequence: Synthetic oligonucleotide
  Target: ATXN1; (+) strand; PAM type: YTN; PAM sequence: TTA
gcacaggcttcttacacatt

SEQ ID NO: 308740 - DNA, 20 bp, Artificial Sequence
  Description of Artificial Sequence: Synthetic oligonucleotide
  Target: ATXN1; (+) strand; PAM type: YTN; PAM sequence: CTT
cttacacatttttgtcacct

SEQ ID NO: 308741 - DNA, 20 bp, Artificial Sequence
  Description of Artificial Sequence: Synthetic oligonucleotide
  Target: ATXN1; (+) strand; PAM type: YTN; PAM sequence: TTC
ttacacatttttgtcacctt

SEQ ID NO: 308742 - DNA, 20 bp, Artificial Sequence
  Description of Artificial Sequence: Synthetic oligonucleotide
  Target: ATXN1; (+) strand; PAM type: YTN; PAM sequence: CTT
acacatttttgtcacctttt

SEQ ID NO: 308743 - DNA, 20 bp, Artificial Sequence
  Description of Artificial Sequence: Synthetic oligonucleotide
  Target: ATXN1; (+) strand; PAM type: YTN; PAM sequence: TTA
cacatttttgtcaccttttc

SEQ ID NO: 308744 - DNA, 20 bp, Artificial Sequence
  Description of Artificial Sequence: Synthetic oligonucleotide
  Target: ATXN1; (+) strand; PAM type: YTN; PAM sequence: TTT
ttgtcaccttttcactcact

SEQ ID NO: 308745 - DNA, 20 bp, Artificial Sequence
  Description of Artificial Sequence: Synthetic oligonucleotide
  Target: ATXN1; (+) strand; PAM type: YTN; PAM sequence: TTT
tgtcaccttttcactcactg

SEQ ID NO: 308746 - DNA, 20 bp, Artificial Sequence
  Description of Artificial Sequence: Synthetic oligonucleotide
  Target: ATXN1; (+) strand; PAM type: YTN; PAM sequence: TTT
gtcaccttttcactcactgt

SEQ ID NO: 308747 - DNA, 20 bp, Artificial Sequence
  Description of Artificial Sequence: Synthetic oligonucleotide
  Target: ATXN1; (+) strand; PAM type: YTN; PAM sequence: TTG
tcaccttttcactcactgtg

SEQ ID NO: 308748 - DNA, 20 bp, Artificial Sequence
  Description of Artificial Sequence: Synthetic oligonucleotide
  Target: ATXN1; (+) strand; PAM type: YTN; PAM sequence: CTT
ttcactcactgtgtgatgga

SEQ ID NO: 308749 - DNA, 20 bp, Artificial Sequence
  Description of Artificial Sequence: Synthetic oligonucleotide
  Target: ATXN1; (+) strand; PAM type: YTN; PAM sequence: TTT
tcactcactgtgtgatggac

SEQ ID NO: 308750 - DNA, 20 bp, Artificial Sequence
  Description of Artificial Sequence: Synthetic oligonucleotide
  Target: ATXN1; (+) strand; PAM type: YTN; PAM sequence: TTT
cactcactgtgtgatggaca

SEQ ID NO: 308751 - DNA, 20 bp, Artificial Sequence
  Description of Artificial Sequence: Synthetic oligonucleotide
  Target: ATXN1; (+) strand; PAM type: YTN; PAM sequence: TTC
actcactgtgtgatggacaa

SEQ ID NO: 308752 - DNA, 20 bp, Artificial Sequence
  Description of Artificial Sequence: Synthetic oligonucleotide
  Target: ATXN1; (+) strand; PAM type: YTN; PAM sequence: CTC
actgtgtgatggacaaagca

SEQ ID NO: 308753 - DNA, 20 bp, Artificial Sequence
  Description of Artificial Sequence: Synthetic oligonucleotide
  Target: ATXN1; (+) strand; PAM type: YTN; PAM sequence: CTG
tgtgatggacaaagcacaaa

SEQ ID NO: 308754 - DNA, 20 bp, Artificial Sequence
  Description of Artificial Sequence: Synthetic oligonucleotide
  Target: ATXN1; (+) strand; PAM type: YTN; PAM sequence: CTT
tttccaccactgtggttcac

SEQ ID NO: 308755 - DNA, 20 bp, Artificial Sequence
  Description of Artificial Sequence: Synthetic oligonucleotide
  Target: ATXN1; (+) strand; PAM type: YTN; PAM sequence: TTT
ttccaccactgtggttcaca

SEQ ID NO: 308756 - DNA, 20 bp, Artificial Sequence
  Description of Artificial Sequence: Synthetic oligonucleotide
  Target: ATXN1; (+) strand; PAM type: YTN; PAM sequence: TTT
tccaccactgtggttcacag

SEQ ID NO: 308757 - DNA, 20 bp, Artificial Sequence
  Description of Artificial Sequence: Synthetic oligonucleotide
  Target: ATXN1; (+) strand; PAM type: YTN; PAM sequence: TTT
ccaccactgtggttcacagg

SEQ ID NO: 308758 - DNA, 20 bp, Artificial Sequence
  Description of Artificial Sequence: Synthetic oligonucleotide
  Target: ATXN1; (+) strand; PAM type: YTN; PAM sequence: TTC
caccactgtggttcacagga

SEQ ID NO: 308759 - DNA, 20 bp, Artificial Sequence
  Description of Artificial Sequence: Synthetic oligonucleotide
  Target: ATXN1; (+) strand; PAM type: YTN; PAM sequence: CTG
tggttcacaggaccccatgc

SEQ ID NO: 308760 - DNA, 20 bp, Artificial Sequence
  Description of Artificial Sequence: Synthetic oligonucleotide
  Target: ATXN1; (+) strand; PAM type: YTN; PAM sequence: TTC
acaggaccccatgctggttc

SEQ ID NO: 308761 - DNA, 20 bp, Artificial Sequence
  Description of Artificial Sequence: Synthetic oligonucleotide
  Target: ATXN1; (+) strand; PAM type: YTN; PAM sequence: CTG
gttcctgaccacaattatac

SEQ ID NO: 308762 - DNA, 20 bp, Artificial Sequence
  Description of Artificial Sequence: Synthetic oligonucleotide
  Target: ATXN1; (+) strand; PAM type: YTN; PAM sequence: TTC
ctgaccacaattatacacac

SEQ ID NO: 308763 - DNA, 20 bp, Artificial Sequence
  Description of Artificial Sequence: Synthetic oligonucleotide
  Target: ATXN1; (+) strand; PAM type: YTN; PAM sequence: CTG
accacaattatacacaccac

SEQ ID NO: 308764 - DNA, 20 bp, Artificial Sequence
  Description of Artificial Sequence: Synthetic oligonucleotide
  Target: ATXN1; (+) strand; PAM type: YTN; PAM sequence: TTA
tacacaccacaattatatac

SEQ ID NO: 308765 - DNA, 20 bp, Artificial Sequence
  Description of Artificial Sequence: Synthetic oligonucleotide
  Target: ATXN1; (+) strand; PAM type: YTN; PAM sequence: TTA
tatacatcacagtccatatt

SEQ ID NO: 308766 - DNA, 20 bp, Artificial Sequence
  Description of Artificial Sequence: Synthetic oligonucleotide
  Target: ATXN1; (+) strand; PAM type: YTN; PAM sequence: TTA
atagatggaatcacatccaa

SEQ ID NO: 308767 - DNA, 20 bp, Artificial Sequence
  Description of Artificial Sequence: Synthetic oligonucleotide
  Target: ATXN1; (+) strand; PAM type: YTN; PAM sequence: TTT
gtaacataagcatcacaggg

SEQ ID NO: 308768 - DNA, 20 bp, Artificial Sequence
  Description of Artificial Sequence: Synthetic oligonucleotide
  Target: ATXN1; (+) strand; PAM type: YTN; PAM sequence: TTG
taacataagcatcacagggg

SEQ ID NO: 308769 - DNA, 20 bp, Artificial Sequence
  Description of Artificial Sequence: Synthetic oligonucleotide
  Target: ATXN1; (+) strand; PAM type: YTN; PAM sequence: TTG
cccattcactagatgccaca

SEQ ID NO: 308770 - DNA, 20 bp, Artificial Sequence
  Description of Artificial Sequence: Synthetic oligonucleotide
  Target: ATXN1; (+) strand; PAM type: YTN; PAM sequence: TTC
actagatgccacatactgga

SEQ ID NO: 308771 - DNA, 20 bp, Artificial Sequence
  Description of Artificial Sequence: Synthetic oligonucleotide
  Target: ATXN1; (+) strand; PAM type: YTN; PAM sequence: CTA
gatgccacatactggaaaga

SEQ ID NO: 308772 - DNA, 20 bp, Artificial Sequence
  Description of Artificial Sequence: Synthetic oligonucleotide
  Target: ATXN1; (+) strand; PAM type: YTN; PAM sequence: CTG
gaaagagggcagtccctcct

SEQ ID NO: 308773 - DNA, 20 bp, Artificial Sequence
  Description of Artificial Sequence: Synthetic oligonucleotide
  Target: ATXN1; (+) strand; PAM type: YTN; PAM sequence: CTC
ctatcgctgggccaggaaag

SEQ ID NO: 308774 - DNA, 20 bp, Artificial Sequence
  Description of Artificial Sequence: Synthetic oligonucleotide
  Target: ATXN1; (+) strand; PAM type: YTN; PAM sequence: CTA
tcgctgggccaggaaagggg

SEQ ID NO: 308775 - DNA, 20 bp, Artificial Sequence
  Description of Artificial Sequence: Synthetic oligonucleotide
  Target: ATXN1; (+) strand; PAM type: YTN; PAM sequence: CTG
ggccaggaaaggggttgtga

SEQ ID NO: 308776 - DNA, 20 bp, Artificial Sequence
  Description of Artificial Sequence: Synthetic oligonucleotide
  Target: ATXN1; (+) strand; PAM type: YTN; PAM sequence: TTG
tgaagtattatacaagggga

SEQ ID NO: 308777 - DNA, 20 bp, Artificial Sequence
  Description of Artificial Sequence: Synthetic oligonucleotide
  Target: ATXN1; (+) strand; PAM type: YTN; PAM sequence: TTA
tacaaggggaagaatggggt

SEQ ID NO: 308778 - DNA, 20 bp, Artificial Sequence
  Description of Artificial Sequence: Synthetic oligonucleotide
  Target: ATXN1; (+) strand; PAM type: YTN; PAM sequence: CTA
tgggaacccagaaaaggtag

SEQ ID NO: 308779 - DNA, 20 bp, Artificial Sequence
  Description of Artificial Sequence: Synthetic oligonucleotide
  Target: ATXN1; (+) strand; PAM type: YTN; PAM sequence: CTA
gtccaagggcttcgtgagga

SEQ ID NO: 308780 - DNA, 20 bp, Artificial Sequence
  Description of Artificial Sequence: Synthetic oligonucleotide
  Target: ATXN1; (+) strand; PAM type: YTN; PAM sequence: CTT
cgtgaggaagagactctaag

SEQ ID NO: 308781 - DNA, 20 bp, Artificial Sequence
  Description of Artificial Sequence: Synthetic oligonucleotide
  Target: ATXN1; (+) strand; PAM type: YTN; PAM sequence: TTC
gtgaggaagagactctaagc

SEQ ID NO: 308782 - DNA, 20 bp, Artificial Sequence
  Description of Artificial Sequence: Synthetic oligonucleotide
  Target: ATXN1; (+) strand; PAM type: YTN; PAM sequence: CTC
taagctgagatttcaagaat

SEQ ID NO: 308783 - DNA, 20 bp, Artificial Sequence
  Description of Artificial Sequence: Synthetic oligonucleotide
  Target: ATXN1; (+) strand; PAM type: YTN; PAM sequence: CTA
agctgagatttcaagaatga

SEQ ID NO: 308784 - DNA, 20 bp, Artificial Sequence
  Description of Artificial Sequence: Synthetic oligonucleotide
  Target: ATXN1; (+) strand; PAM type: YTN; PAM sequence: CTG
agatttcaagaatgagggaa

SEQ ID NO: 308785 - DNA, 20 bp, Artificial Sequence
  Description of Artificial Sequence: Synthetic oligonucleotide
  Target: ATXN1; (+) strand; PAM type: YTN; PAM sequence: TTT
caagaatgagggaaaggtag

SEQ ID NO: 308786 - DNA, 20 bp, Artificial Sequence
  Description of Artificial Sequence: Synthetic oligonucleotide
  Target: ATXN1; (+) strand; PAM type: YTN; PAM sequence: TTC
aagaatgagggaaaggtagc

SEQ ID NO: 308787 - DNA, 20 bp, Artificial Sequence
  Description of Artificial Sequence: Synthetic oligonucleotide
  Target: ATXN1; (+) strand; PAM type: YTN; PAM sequence: CTG
ggttctaaggaggaagaaca

SEQ ID NO: 308788 - DNA, 20 bp, Artificial Sequence
  Description of Artificial Sequence: Synthetic oligonucleotide
  Target: ATXN1; (+) strand; PAM type: YTN; PAM sequence: TTC
taaggaggaagaacaacatg

SEQ ID NO: 308789 - DNA, 20 bp, Artificial Sequence
  Description of Artificial Sequence: Synthetic oligonucleotide
  Target: ATXN1; (+) strand; PAM type: YTN; PAM sequence: CTA
aggaggaagaacaacatgtc

SEQ ID NO: 308790 - DNA, 20 bp, Artificial Sequence
  Description of Artificial Sequence: Synthetic oligonucleotide
  Target: ATXN1; (+) strand; PAM type: YTN; PAM sequence: CTA
aaggctggagcaaaaaacag

SEQ ID NO: 308791 - DNA, 20 bp, Artificial Sequence
  Description of Artificial Sequence: Synthetic oligonucleotide
  Target: ATXN1; (+) strand; PAM type: YTN; PAM sequence: CTG
gagcaaaaaacagagtatgg

SEQ ID NO: 308792 - DNA, 20 bp, Artificial Sequence
  Description of Artificial Sequence: Synthetic oligonucleotide
  Target: ATXN1; (+) strand; PAM type: YTN; PAM sequence: CTT
gaaggaggaagtgcgatggg

SEQ ID NO: 308793 - DNA, 20 bp, Artificial Sequence
  Description of Artificial Sequence: Synthetic oligonucleotide
  Target: ATXN1; (+) strand; PAM type: YTN; PAM sequence: TTG
aaggaggaagtgcgatggga

SEQ ID NO: 308794 - DNA, 20 bp, Artificial Sequence
  Description of Artificial Sequence: Synthetic oligonucleotide
  Target: ATXN1; (+) strand; PAM type: YTN; PAM sequence: CTG
gagagataaggaaggtcctc

SEQ ID NO: 308795 - DNA, 20 bp, Artificial Sequence
  Description of Artificial Sequence: Synthetic oligonucleotide
  Target: ATXN1; (+) strand; PAM type: YTN; PAM sequence: CTC
aaaacctatggagccaggct

SEQ ID NO: 308796 - DNA, 20 bp, Artificial Sequence
  Description of Artificial Sequence: Synthetic oligonucleotide
  Target: ATXN1; (+) strand; PAM type: YTN; PAM sequence: CTA
tggagccaggctaaggattc

SEQ ID NO: 308797 - DNA, 20 bp, Artificial Sequence
  Description of Artificial Sequence: Synthetic oligonucleotide
  Target: ATXN1; (+) strand; PAM type: YTN; PAM sequence: CTA
aggattctagactttatcct

SEQ ID NO: 308798 - DNA, 20 bp, Artificial Sequence
  Description of Artificial Sequence: Synthetic oligonucleotide
  Target: ATXN1; (+) strand; PAM type: YTN; PAM sequence: TTC
tagactttatcctgaggacc

SEQ ID NO: 308799 - DNA, 20 bp, Artificial Sequence
  Description of Artificial Sequence: Synthetic oligonucleotide
  Target: ATXN1; (+) strand; PAM type: YTN; PAM sequence: CTA
gactttatcctgaggaccat

SEQ ID NO: 308800 - DNA, 20 bp, Artificial Sequence
  Description of Artificial Sequence: Synthetic oligonucleotide
  Target: ATXN1; (+) strand; PAM type: YTN; PAM sequence: CTT
tatcctgaggaccatgagaa

SEQ ID NO: 308801 - DNA, 20 bp, Artificial Sequence
  Description of Artificial Sequence: Synthetic oligonucleotide
  Target: ATXN1; (+) strand; PAM type: YTN; PAM sequence: TTT
atcctgaggaccatgagaac

SEQ ID NO: 308802 - DNA, 20 bp, Artificial Sequence
  Description of Artificial Sequence: Synthetic oligonucleotide
  Target: ATXN1; (+) strand; PAM type: YTN; PAM sequence: TTA
tcctgaggaccatgagaacc

SEQ ID NO: 308803 - DNA, 20 bp, Artificial Sequence
  Description of Artificial Sequence: Synthetic oligonucleotide
  Target: ATXN1; (+) strand; PAM type: YTN; PAM sequence: CTG
aggaccatgagaacccaggg

SEQ ID NO: 308804 - DNA, 20 bp, Artificial Sequence
  Description of Artificial Sequence: Synthetic oligonucleotide
  Target: ATXN1; (+) strand; PAM type: YTN; PAM sequence: TTA
agaaaaacagagatgtcagc

SEQ ID NO: 308805 - DNA, 20 bp, Artificial Sequence
  Description of Artificial Sequence: Synthetic oligonucleotide
  Target: ATXN1; (+) strand; PAM type: YTN; PAM sequence: TTT
caaatactaacaaatgttca

SEQ ID NO: 308806 - DNA, 20 bp, Artificial Sequence
  Description of Artificial Sequence: Synthetic oligonucleotide
  Target: ATXN1; (+) strand; PAM type: YTN; PAM sequence: TTC
aaatactaacaaatgttcat

SEQ ID NO: 308807 - DNA, 20 bp, Artificial Sequence
  Description of Artificial Sequence: Synthetic oligonucleotide
  Target: ATXN1; (+) strand; PAM type: YTN; PAM sequence: CTA
acaaatgttcattttggctt

SEQ ID NO: 308808 - DNA, 20 bp, Artificial Sequence
  Description of Artificial Sequence: Synthetic oligonucleotide
  Target: ATXN1; (+) strand; PAM type: YTN; PAM sequence: TTC
attttggcttcaaagaggaa

SEQ ID NO: 308809 - DNA, 20 bp, Artificial Sequence
  Description of Artificial Sequence: Synthetic oligonucleotide
  Target: ATXN1; (+) strand; PAM type: YTN; PAM sequence: TTT
tggcttcaaagaggaaaaac

SEQ ID NO: 308810 - DNA, 20 bp, Artificial Sequence
  Description of Artificial Sequence: Synthetic oligonucleotide
  Target: ATXN1; (+) strand; PAM type: YTN; PAM sequence: TTT
ggcttcaaagaggaaaaaca

SEQ ID NO: 308811 - DNA, 20 bp, Artificial Sequence
  Description of Artificial Sequence: Synthetic oligonucleotide
  Target: ATXN1; (+) strand; PAM type: YTN; PAM sequence: TTG
gcttcaaagaggaaaaacat

SEQ ID NO: 308812 - DNA, 20 bp, Artificial Sequence
  Description of Artificial Sequence: Synthetic oligonucleotide
  Target: ATXN1; (+) strand; PAM type: YTN; PAM sequence: CTT
caaagaggaaaaacatgttg

SEQ ID NO: 308813 - DNA, 20 bp, Artificial Sequence
  Description of Artificial Sequence: Synthetic oligonucleotide
  Target: ATXN1; (+) strand; PAM type: YTN; PAM sequence: TTC
aaagaggaaaaacatgttgg

SEQ ID NO: 308814 - DNA, 20 bp, Artificial Sequence
  Description of Artificial Sequence: Synthetic oligonucleotide
  Target: ATXN1; (+) strand; PAM type: YTN; PAM sequence: TTG
gaccagaacaacaatacatc

SEQ ID NO: 308815 - DNA, 20 bp, Artificial Sequence
  Description of Artificial Sequence: Synthetic oligonucleotide
  Target: ATXN1; (+) strand; PAM type: YTN; PAM sequence: CTA
gacaggccatttaggaggta

SEQ ID NO: 308816 - DNA, 20 bp, Artificial Sequence
  Description of Artificial Sequence: Synthetic oligonucleotide
  Target: ATXN1; (+) strand; PAM type: YTN; PAM sequence: TTT
aggaggtatatcatatgcca

SEQ ID NO: 308817 - DNA, 20 bp, Artificial Sequence
  Description of Artificial Sequence: Synthetic oligonucleotide
  Target: ATXN1; (+) strand; PAM type: YTN; PAM sequence: TTA
ggaggtatatcatatgccaa

SEQ ID NO: 308818 - DNA, 20 bp, Artificial Sequence
  Description of Artificial Sequence: Synthetic oligonucleotide
  Target: ATXN1; (+) strand; PAM type: YTN; PAM sequence: CTC
agcagagccactcagctaaa

SEQ ID NO: 308819 - DNA, 20 bp, Artificial Sequence
  Description of Artificial Sequence: Synthetic oligonucleotide
  Target: ATXN1; (+) strand; PAM type: YTN; PAM sequence: CTC
agctaaaactcacactttga

SEQ ID NO: 308820 - DNA, 20 bp, Artificial Sequence
  Description of Artificial Sequence: Synthetic oligonucleotide
  Target: ATXN1; (+) strand; PAM type: YTN; PAM sequence: CTA
aaactcacactttgagacca

SEQ ID NO: 308821 - DNA, 20 bp, Artificial Sequence
  Description of Artificial Sequence: Synthetic oligonucleotide
  Target: ATXN1; (+) strand; PAM type: YTN; PAM sequence: CTC
acactttgagaccagccttc

SEQ ID NO: 308822 - DNA, 20 bp, Artificial Sequence
  Description of Artificial Sequence: Synthetic oligonucleotide
  Target: ATXN1; (+) strand; PAM type: YTN; PAM sequence: CTT
tgagaccagccttcctcaaa

SEQ ID NO: 308823 - DNA, 20 bp, Artificial Sequence
  Description of Artificial Sequence: Synthetic oligonucleotide
  Target: ATXN1; (+) strand; PAM type: YTN; PAM sequence: TTT
gagaccagccttcctcaaaa

SEQ ID NO: 308824 - DNA, 20 bp, Artificial Sequence
  Description of Artificial Sequence: Synthetic oligonucleotide
  Target: ATXN1; (+) strand; PAM type: YTN; PAM sequence: TTG
agaccagccttcctcaaaaa

SEQ ID NO: 308825 - DNA, 20 bp, Artificial Sequence
  Description of Artificial Sequence: Synthetic oligonucleotide
  Target: ATXN1; (+) strand; PAM type: YTN; PAM sequence: CTT
cctcaaaaaattcaatccct

SEQ ID NO: 308826 - DNA, 20 bp, Artificial Sequence
  Description of Artificial Sequence: Synthetic oligonucleotide
  Target: ATXN1; (+) strand; PAM type: YTN; PAM sequence: TTC
ctcaaaaaattcaatcccta

SEQ ID NO: 308827 - DNA, 20 bp, Artificial Sequence
  Description of Artificial Sequence: Synthetic oligonucleotide
  Target: ATXN1; (+) strand; PAM type: YTN; PAM sequence: CTC
aaaaaattcaatccctagga

SEQ ID NO: 308828 - DNA, 20 bp, Artificial Sequence
  Description of Artificial Sequence: Synthetic oligonucleotide
  Target: ATXN1; (+) strand; PAM type: YTN; PAM sequence: TTC
aatccctaggaagttgttcc

SEQ ID NO: 308829 - DNA, 20 bp, Artificial Sequence
  Description of Artificial Sequence: Synthetic oligonucleotide
  Target: ATXN1; (+) strand; PAM type: YTN; PAM sequence: CTA
ggaagttgttcccaaccttc

SEQ ID NO: 308830 - DNA, 20 bp, Artificial Sequence
  Description of Artificial Sequence: Synthetic oligonucleotide
  Target: ATXN1; (+) strand; PAM type: YTN; PAM sequence: TTG
ttcccaaccttccactggaa

SEQ ID NO: 308831 - DNA, 20 bp, Artificial Sequence
  Description of Artificial Sequence: Synthetic oligonucleotide
  Target: ATXN1; (+) strand; PAM type: YTN; PAM sequence: TTC
ccaaccttccactggaagag

SEQ ID NO: 308832 - DNA, 20 bp, Artificial Sequence
  Description of Artificial Sequence: Synthetic oligonucleotide
  Target: ATXN1; (+) strand; PAM type: YTN; PAM sequence: CTT
ccactggaagagctatcccc

SEQ ID NO: 308833 - DNA, 20 bp, Artificial Sequence
  Description of Artificial Sequence: Synthetic oligonucleotide
  Target: ATXN1; (+) strand; PAM type: YTN; PAM sequence: TTC
cactggaagagctatccccg

SEQ ID NO: 308834 - DNA, 20 bp, Artificial Sequence
  Description of Artificial Sequence: Synthetic oligonucleotide
  Target: ATXN1; (+) strand; PAM type: YTN; PAM sequence: CTG
gaagagctatccccggagaa

SEQ ID NO: 308835 - DNA, 20 bp, Artificial Sequence
  Description of Artificial Sequence: Synthetic oligonucleotide
  Target: ATXN1; (+) strand; PAM type: YTN; PAM sequence: CTA
tccccggagaagagctacaa

SEQ ID NO: 308836 - DNA, 20 bp, Artificial Sequence
  Description of Artificial Sequence: Synthetic oligonucleotide
  Target: ATXN1; (+) strand; PAM type: YTN; PAM sequence: CTA
caacaggaaaggaatcaggg

SEQ ID NO: 308837 - DNA, 20 bp, Artificial Sequence
  Description of Artificial Sequence: Synthetic oligonucleotide
  Target: ATXN1; (+) strand; PAM type: YTN; PAM sequence: CTC
tctggttcctacatggatga

SEQ ID NO: 308838 - DNA, 20 bp, Artificial Sequence
  Description of Artificial Sequence: Synthetic oligonucleotide
  Target: ATXN1; (+) strand; PAM type: YTN; PAM sequence: CTC
tggttcctacatggatgaaa

SEQ ID NO: 308839 - DNA, 20 bp, Artificial Sequence
  Description of Artificial Sequence: Synthetic oligonucleotide
  Target: ATXN1; (+) strand; PAM type: YTN; PAM sequence: CTG
gttcctacatggatgaaaac

SEQ ID NO: 308840 - DNA, 20 bp, Artificial Sequence
  Description of Artificial Sequence: Synthetic oligonucleotide
  Target: ATXN1; (+) strand; PAM type: YTN; PAM sequence: TTC
ctacatggatgaaaaccagc

SEQ ID NO: 308841 - DNA, 20 bp, Artificial Sequence
  Description of Artificial Sequence: Synthetic oligonucleotide
  Target: ATXN1; (+) strand; PAM type: YTN; PAM sequence: CTA
catggatgaaaaccagcgcc

SEQ ID NO: 308842 - DNA, 20 bp, Artificial Sequence
  Description of Artificial Sequence: Synthetic oligonucleotide
  Target: ATXN1; (+) strand; PAM type: YTN; PAM sequence: TTC
cttagcagggcagcctgcta

SEQ ID NO: 308843 - DNA, 20 bp, Artificial Sequence
  Description of Artificial Sequence: Synthetic oligonucleotide
  Target: ATXN1; (+) strand; PAM type: YTN; PAM sequence: CTT
agcagggcagcctgctacgt

SEQ ID NO: 308844 - DNA, 20 bp, Artificial Sequence
  Description of Artificial Sequence: Synthetic oligonucleotide
  Target: ATXN1; (+) strand; PAM type: YTN; PAM sequence: TTA
gcagggcagcctgctacgta

SEQ ID NO: 308845 - DNA, 20 bp, Artificial Sequence
  Description of Artificial Sequence: Synthetic oligonucleotide
  Target: ATXN1; (+) strand; PAM type: YTN; PAM sequence: CTG
ctacgtagcagaaatgtaag

SEQ ID NO: 308846 - DNA, 20 bp, Artificial Sequence
  Description of Artificial Sequence: Synthetic oligonucleotide
  Target: ATXN1; (+) strand; PAM type: YTN; PAM sequence: CTA
cgtagcagaaatgtaagaca

SEQ ID NO: 308847 - DNA, 20 bp, Artificial Sequence
  Description of Artificial Sequence: Synthetic oligonucleotide
  Target: ATXN1; (+) strand; PAM type: YTN; PAM sequence: TTG
taaagaccccgaccccagag

SEQ ID NO: 308848 - DNA, 20 bp, Artificial Sequence
  Description of Artificial Sequence: Synthetic oligonucleotide
  Target: ATXN1; (+) strand; PAM type: YTN; PAM sequence: CTT
ggataatggttagactttgg

SEQ ID NO: 308849 - DNA, 20 bp, Artificial Sequence
  Description of Artificial Sequence: Synthetic oligonucleotide
  Target: ATXN1; (+) strand; PAM type: YTN; PAM sequence: TTG
gataatggttagactttggc

SEQ ID NO: 308850 - DNA, 20 bp, Artificial Sequence
  Description of Artificial Sequence: Synthetic oligonucleotide
  Target: ATXN1; (+) strand; PAM type: YTN; PAM sequence: TTA
gactttggccaggcctgaga

SEQ ID NO: 308851 - DNA, 20 bp, Artificial Sequence
  Description of Artificial Sequence: Synthetic oligonucleotide
  Target: ATXN1; (+) strand; PAM type: YTN; PAM sequence: CTT
tggccaggcctgagattcct

SEQ ID NO: 308852 - DNA, 20 bp, Artificial Sequence
  Description of Artificial Sequence: Synthetic oligonucleotide
  Target: ATXN1; (+) strand; PAM type: YTN; PAM sequence: TTT
ggccaggcctgagattcctg

SEQ ID NO: 308853 - DNA, 20 bp, Artificial Sequence
  Description of Artificial Sequence: Synthetic oligonucleotide
  Target: ATXN1; (+) strand; PAM type: YTN; PAM sequence: TTG
gccaggcctgagattcctga

SEQ ID NO: 308854 - DNA, 20 bp, Artificial Sequence
  Description of Artificial Sequence: Synthetic oligonucleotide
  Target: ATXN1; (+) strand; PAM type: YTN; PAM sequence: CTG
agattcctgactgatctctc

SEQ ID NO: 308855 - DNA, 20 bp, Artificial Sequence
  Description of Artificial Sequence: Synthetic oligonucleotide
  Target: ATXN1; (+) strand; PAM type: YTN; PAM sequence: TTC
ctgactgatctctctaggcc

SEQ ID NO: 308856 - DNA, 20 bp, Artificial Sequence
  Description of Artificial Sequence: Synthetic oligonucleotide
  Target: ATXN1; (+) strand; PAM type: YTN; PAM sequence: CTG
actgatctctctaggcccta

SEQ ID NO: 308857 - DNA, 20 bp, Artificial Sequence
  Description of Artificial Sequence: Synthetic oligonucleotide
  Target: ATXN1; (+) strand; PAM type: YTN; PAM sequence: CTG
atctctctaggccctagtca

SEQ ID NO: 308858 - DNA, 20 bp, Artificial Sequence
  Description of Artificial Sequence: Synthetic oligonucleotide
  Target: ATXN1; (+) strand; PAM type: YTN; PAM sequence: CTC
tctaggccctagtcagggag

SEQ ID NO: 308859 - DNA, 20 bp, Artificial Sequence
  Description of Artificial Sequence: Synthetic oligonucleotide
  Target: ATXN1; (+) strand; PAM type: YTN; PAM sequence: CTC
taggccctagtcagggaggc

SEQ ID NO: 308860 - DNA, 20 bp, Artificial Sequence
  Description of Artificial Sequence: Synthetic oligonucleotide
  Target: ATXN1; (+) strand; PAM type: YTN; PAM sequence: CTA
ggccctagtcagggaggctg

SEQ ID NO: 308861 - DNA, 20 bp, Artificial Sequence
  Description of Artificial Sequence: Synthetic oligonucleotide
  Target: ATXN1; (+) strand; PAM type: YTN; PAM sequence: CTA
gtcagggaggctgccagaca

SEQ ID NO: 308862 - DNA, 20 bp, Artificial Sequence
  Description of Artificial Sequence: Synthetic oligonucleotide
  Target: ATXN1; (+) strand; PAM type: YTN; PAM sequence: CTG
ccagacatgtttctacccac

SEQ ID NO: 308863 - DNA, 20 bp, Artificial Sequence
  Description of Artificial Sequence: Synthetic oligonucleotide
  Target: ATXN1; (+) strand; PAM type: YTN; PAM sequence: TTT
ctacccactgctcccaggac

SEQ ID NO: 308864 - DNA, 20 bp, Artificial Sequence
  Description of Artificial Sequence: Synthetic oligonucleotide
  Target: ATXN1; (+) strand; PAM type: YTN; PAM sequence: TTC
tacccactgctcccaggaca

SEQ ID NO: 308865 - DNA, 20 bp, Artificial Sequence
  Description of Artificial Sequence: Synthetic oligonucleotide
  Target: ATXN1; (+) strand; PAM type: YTN; PAM sequence: CTA
cccactgctcccaggacagg

SEQ ID NO: 308866 - DNA, 20 bp, Artificial Sequence
  Description of Artificial Sequence: Synthetic oligonucleotide
  Target: ATXN1; (+) strand; PAM type: YTN; PAM sequence: CTG
ctcccaggacagggctccct

SEQ ID NO: 308867 - DNA, 20 bp, Artificial Sequence
  Description of Artificial Sequence: Synthetic oligonucleotide
  Target: ATXN1; (+) strand; PAM type: YTN; PAM sequence: CTC
ccaggacagggctccctgag

SEQ ID NO: 308868 - DNA, 20 bp, Artificial Sequence
  Description of Artificial Sequence: Synthetic oligonucleotide
  Target: ATXN1; (+) strand; PAM type: YTN; PAM sequence: CTC
cctgagaaacacacaggtca

SEQ ID NO: 308869 - DNA, 20 bp, Artificial Sequence
  Description of Artificial Sequence: Synthetic oligonucleotide
  Target: ATXN1; (+) strand; PAM type: YTN; PAM sequence: CTG
agaaacacacaggtcagcaa

SEQ ID NO: 308870 - DNA, 20 bp, Artificial Sequence
  Description of Artificial Sequence: Synthetic oligonucleotide
  Target: ATXN1; (+) strand; PAM type: YTN; PAM sequence: TTG
agaactgggcagagaggatg

SEQ ID NO: 308871 - DNA, 20 bp, Artificial Sequence
  Description of Artificial Sequence: Synthetic oligonucleotide
  Target: ATXN1; (+) strand; PAM type: YTN; PAM sequence: CTG
ggcagagaggatgccacagc

SEQ ID NO: 308872 - DNA, 20 bp, Artificial Sequence
  Description of Artificial Sequence: Synthetic oligonucleotide
  Target: ATXN1; (+) strand; PAM type: YTN; PAM sequence: CTT
ggaaatagaaagactgggac

SEQ ID NO: 308873 - DNA, 20 bp, Artificial Sequence
  Description of Artificial Sequence: Synthetic oligonucleotide
  Target: ATXN1; (+) strand; PAM type: YTN; PAM sequence: TTG
gaaatagaaagactgggact

SEQ ID NO: 308874 - DNA, 20 bp, Artificial Sequence
  Description of Artificial Sequence: Synthetic oligonucleotide
  Target: ATXN1; (+) strand; PAM type: YTN; PAM sequence: CTG
ggacttcaacaggaaacagt

SEQ ID NO: 308875 - DNA, 20 bp, Artificial Sequence
  Description of Artificial Sequence: Synthetic oligonucleotide
  Target: ATXN1; (+) strand; PAM type: YTN; PAM sequence: CTT
caacaggaaacagttcccaa

SEQ ID NO: 308876 - DNA, 20 bp, Artificial Sequence
  Description of Artificial Sequence: Synthetic oligonucleotide
  Target: ATXN1; (+) strand; PAM type: YTN; PAM sequence: TTC
aacaggaaacagttcccaag

SEQ ID NO: 308877 - DNA, 20 bp, Artificial Sequence
  Description of Artificial Sequence: Synthetic oligonucleotide
  Target: ATXN1; (+) strand; PAM type: YTN; PAM sequence: TTC
ccaaggggaaaagtgagcag

SEQ ID NO: 308878 - DNA, 20 bp, Artificial Sequence
  Description of Artificial Sequence: Synthetic oligonucleotide
  Target: ATXN1; (+) strand; PAM type: YTN; PAM sequence: CTA
ttcccagcaaagccatccag

SEQ ID NO: 308879 - DNA, 20 bp, Artificial Sequence
  Description of Artificial Sequence: Synthetic oligonucleotide
  Target: ATXN1; (+) strand; PAM type: YTN; PAM sequence: TTC
ccagcaaagccatccagtgg

SEQ ID NO: 308880 - DNA, 20 bp, Artificial Sequence
  Description of Artificial Sequence: Synthetic oligonucleotide
  Target: ATXN1; (+) strand; PAM type: YTN; PAM sequence: CTC
gccagcctggtgcagaattt

SEQ ID NO: 308881 - DNA, 20 bp, Artificial Sequence
  Description of Artificial Sequence: Synthetic oligonucleotide
  Target: ATXN1; (+) strand; PAM type: YTN; PAM sequence: CTG
gtgcagaatttgagctgcgg

SEQ ID NO: 308882 - DNA, 20 bp, Artificial Sequence
  Description of Artificial Sequence: Synthetic oligonucleotide
  Target: ATXN1; (+) strand; PAM type: YTN; PAM sequence: TTT
gagctgcggtaatctcattt

SEQ ID NO: 308883 - DNA, 20 bp, Artificial Sequence
  Description of Artificial Sequence: Synthetic oligonucleotide
  Target: ATXN1; (+) strand; PAM type: YTN; PAM sequence: TTG
agctgcggtaatctcattta

SEQ ID NO: 308884 - DNA, 20 bp, Artificial Sequence
  Description of Artificial Sequence: Synthetic oligonucleotide
  Target: ATXN1; (+) strand; PAM type: YTN; PAM sequence: CTG
cggtaatctcatttattcct

SEQ ID NO: 308885 - DNA, 20 bp, Artificial Sequence
  Description of Artificial Sequence: Synthetic oligonucleotide
  Target: ATXN1; (+) strand; PAM type: YTN; PAM sequence: CTC
atttattcctgccaggttgg

SEQ ID NO: 308886 - DNA, 20 bp, Artificial Sequence
  Description of Artificial Sequence: Synthetic oligonucleotide
  Target: ATXN1; (+) strand; PAM type: YTN; PAM sequence: TTT
attcctgccaggttggccct

SEQ ID NO: 308887 - DNA, 20 bp, Artificial Sequence
  Description of Artificial Sequence: Synthetic oligonucleotide
  Target: ATXN1; (+) strand; PAM type: YTN; PAM sequence: TTA
ttcctgccaggttggccctg

SEQ ID NO: 308888 - DNA, 20 bp, Artificial Sequence
  Description of Artificial Sequence: Synthetic oligonucleotide
  Target: ATXN1; (+) strand; PAM type: YTN; PAM sequence: TTC
ctgccaggttggccctgggt

SEQ ID NO: 308889 - DNA, 20 bp, Artificial Sequence
  Description of Artificial Sequence: Synthetic oligonucleotide
  Target: ATXN1; (+) strand; PAM type: YTN; PAM sequence: CTG
ccaggttggccctgggtaca

SEQ ID NO: 308890 - DNA, 20 bp, Artificial Sequence
  Description of Artificial Sequence: Synthetic oligonucleotide
  Target: ATXN1; (+) strand; PAM type: YTN; PAM sequence: TTG
gccctgggtacaagtagaag

SEQ ID NO: 308891 - DNA, 20 bp, Artificial Sequence
  Description of Artificial Sequence: Synthetic oligonucleotide
  Target: ATXN1; (+) strand; PAM type: YTN; PAM sequence: CTG
ggtacaagtagaagaaaaga

SEQ ID NO: 308892 - DNA, 20 bp, Artificial Sequence
  Description of Artificial Sequence: Synthetic oligonucleotide
  Target: ATXN1; (+) strand; PAM type: YTN; PAM sequence: CTG
atcatataaaaacttgaacc

SEQ ID NO: 308893 - DNA, 20 bp, Artificial Sequence
  Description of Artificial Sequence: Synthetic oligonucleotide
  Target: ATXN1; (+) strand; PAM type: YTN; PAM sequence: CTT
gaaccgttgtacaacaaaaa

SEQ ID NO: 308894 - DNA, 20 bp, Artificial Sequence
  Description of Artificial Sequence: Synthetic oligonucleotide
  Target: ATXN1; (+) strand; PAM type: YTN; PAM sequence: TTG
aaccgttgtacaacaaaaag

SEQ ID NO: 308895 - DNA, 20 bp, Artificial Sequence
  Description of Artificial Sequence: Synthetic oligonucleotide
  Target: ATXN1; (+) strand; PAM type: YTN; PAM sequence: TTG
tacaacaaaaagcatcatca

SEQ ID NO: 308896 - DNA, 20 bp, Artificial Sequence
  Description of Artificial Sequence: Synthetic oligonucleotide
  Target: ATXN1; (+) strand; PAM type: YTN; PAM sequence: CTG
aaatgaaaggacactggact

SEQ ID NO: 308897 - DNA, 20 bp, Artificial Sequence
  Description of Artificial Sequence: Synthetic oligonucleotide
  Target: ATXN1; (+) strand; PAM type: YTN; PAM sequence: CTG
gactagggaagtagctgtag

SEQ ID NO: 308898 - DNA, 20 bp, Artificial Sequence
  Description of Artificial Sequence: Synthetic oligonucleotide
  Target: ATXN1; (+) strand; PAM type: YTN; PAM sequence: CTA
gggaagtagctgtagcaaat

SEQ ID NO: 308899 - DNA, 20 bp, Artificial Sequence
  Description of Artificial Sequence: Synthetic oligonucleotide
  Target: ATXN1; (+) strand; PAM type: YTN; PAM sequence: CTG
tagcaaataggactttttaa

SEQ ID NO: 308900 - DNA, 20 bp, Artificial Sequence
  Description of Artificial Sequence: Synthetic oligonucleotide
  Target: ATXN1; (+) strand; PAM type: YTN; PAM sequence: CTT
tttaaatggattaatatcta

SEQ ID NO: 308901 - DNA, 20 bp, Artificial Sequence
  Description of Artificial Sequence: Synthetic oligonucleotide
  Target: ATXN1; (+) strand; PAM type: YTN; PAM sequence: TTT
ttaaatggattaatatctag

SEQ ID NO: 308902 - DNA, 20 bp, Artificial Sequence
  Description of Artificial Sequence: Synthetic oligonucleotide
  Target: ATXN1; (+) strand; PAM type: YTN; PAM sequence: TTT
taaatggattaatatctaga

SEQ ID NO: 308903 - DNA, 20 bp, Artificial Sequence
  Description of Artificial Sequence: Synthetic oligonucleotide
  Target: ATXN1; (+) strand; PAM type: YTN; PAM sequence: TTT
aaatggattaatatctagaa

SEQ ID NO: 308904 - DNA, 20 bp, Artificial Sequence
  Description of Artificial Sequence: Synthetic oligonucleotide
  Target: ATXN1; (+) strand; PAM type: YTN; PAM sequence: TTA
aatggattaatatctagaac

SEQ ID NO: 308905 - DNA, 20 bp, Artificial Sequence
  Description of Artificial Sequence: Synthetic oligonucleotide
  Target: ATXN1; (+) strand; PAM type: YTN; PAM sequence: TTA
atatctagaacatataaaga

SEQ ID NO: 308906 - DNA, 20 bp, Artificial Sequence
  Description of Artificial Sequence: Synthetic oligonucleotide
  Target: ATXN1; (+) strand; PAM type: YTN; PAM sequence: CTA
gaacatataaagagctcata

SEQ ID NO: 308907 - DNA, 20 bp, Artificial Sequence
  Description of Artificial Sequence: Synthetic oligonucleotide
  Target: ATXN1; (+) strand; PAM type: YTN; PAM sequence: CTC
atatacatagattagaaaac

SEQ ID NO: 308908 - DNA, 20 bp, Artificial Sequence
  Description of Artificial Sequence: Synthetic oligonucleotide
  Target: ATXN1; (+) strand; PAM type: YTN; PAM sequence: TTA
gaaaacatcaagacttccat

SEQ ID NO: 308909 - DNA, 20 bp, Artificial Sequence
  Description of Artificial Sequence: Synthetic oligonucleotide
  Target: ATXN1; (+) strand; PAM type: YTN; PAM sequence: CTT
ccatttgctaattgtaaaaa

SEQ ID NO: 308910 - DNA, 20 bp, Artificial Sequence
  Description of Artificial Sequence: Synthetic oligonucleotide
  Target: ATXN1; (+) strand; PAM type: YTN; PAM sequence: TTC
catttgctaattgtaaaaag

SEQ ID NO: 308911 - DNA, 20 bp, Artificial Sequence
  Description of Artificial Sequence: Synthetic oligonucleotide
  Target: ATXN1; (+) strand; PAM type: YTN; PAM sequence: TTT
gctaattgtaaaaagaacaa

SEQ ID NO: 308912 - DNA, 20 bp, Artificial Sequence
  Description of Artificial Sequence: Synthetic oligonucleotide
  Target: ATXN1; (+) strand; PAM type: YTN; PAM sequence: TTG
ctaattgtaaaaagaacaat

SEQ ID NO: 308913 - DNA, 20 bp, Artificial Sequence
  Description of Artificial Sequence: Synthetic oligonucleotide
  Target: ATXN1; (+) strand; PAM type: YTN; PAM sequence: CTA
attgtaaaaagaacaattag

SEQ ID NO: 308914 - DNA, 20 bp, Artificial Sequence
  Description of Artificial Sequence: Synthetic oligonucleotide
  Target: ATXN1; (+) strand; PAM type: YTN; PAM sequence: TTG
taaaaagaacaattagtaaa

SEQ ID NO: 308915 - DNA, 20 bp, Artificial Sequence
  Description of Artificial Sequence: Synthetic oligonucleotide
  Target: ATXN1; (+) strand; PAM type: YTN; PAM sequence: TTA
gtaaataaacacagatggaa

SEQ ID NO: 308916 - DNA, 20 bp, Artificial Sequence
  Description of Artificial Sequence: Synthetic oligonucleotide
  Target: ATXN1; (+) strand; PAM type: YTN; PAM sequence: TTC
catctctgagagggatcaaa

SEQ ID NO: 308917 - DNA, 20 bp, Artificial Sequence
  Description of Artificial Sequence: Synthetic oligonucleotide
  Target: ATXN1; (+) strand; PAM type: YTN; PAM sequence: CTC
tgagagggatcaaaggaatg

SEQ ID NO: 308918 - DNA, 20 bp, Artificial Sequence
  Description of Artificial Sequence: Synthetic oligonucleotide
  Target: ATXN1; (+) strand; PAM type: YTN; PAM sequence: CTG
agagggatcaaaggaatgaa

SEQ ID NO: 308919 - DNA, 20 bp, Artificial Sequence
  Description of Artificial Sequence: Synthetic oligonucleotide
  Target: ATXN1; (+) strand; PAM type: YTN; PAM sequence: CTT
taaaaccaaagagcctatta

SEQ ID NO: 308920 - DNA, 20 bp, Artificial Sequence
  Description of Artificial Sequence: Synthetic oligonucleotide
  Target: ATXN1; (+) strand; PAM type: YTN; PAM sequence: TTT
aaaaccaaagagcctattaa

SEQ ID NO: 308921 - DNA, 20 bp, Artificial Sequence
  Description of Artificial Sequence: Synthetic oligonucleotide
  Target: ATXN1; (+) strand; PAM type: YTN; PAM sequence: TTA
aaaccaaagagcctattaaa

SEQ ID NO: 308922 - DNA, 20 bp, Artificial Sequence
  Description of Artificial Sequence: Synthetic oligonucleotide
  Target: ATXN1; (+) strand; PAM type: YTN; PAM sequence: CTA
ttaaattagccaaaaaatag

SEQ ID NO: 308923 - DNA, 20 bp, Artificial Sequence
  Description of Artificial Sequence: Synthetic oligonucleotide
  Target: ATXN1; (+) strand; PAM type: YTN; PAM sequence: TTA
aattagccaaaaaatagtaa

SEQ ID NO: 308924 - DNA, 20 bp, Artificial Sequence
  Description of Artificial Sequence: Synthetic oligonucleotide
  Target: ATXN1; (+) strand; PAM type: YTN; PAM sequence: TTA
gccaaaaaatagtaagtccc

SEQ ID NO: 308925 - DNA, 20 bp, Artificial Sequence
  Description of Artificial Sequence: Synthetic oligonucleotide
  Target: ATXN1; (+) strand; PAM type: YTN; PAM sequence: TTA
ttaagattgaagctagagac

SEQ ID NO: 308926 - DNA, 20 bp, Artificial Sequence
  Description of Artificial Sequence: Synthetic oligonucleotide
  Target: ATXN1; (+) strand; PAM type: YTN; PAM sequence: TTA
agattgaagctagagacatt

SEQ ID NO: 308927 - DNA, 20 bp, Artificial Sequence
  Description of Artificial Sequence: Synthetic oligonucleotide
  Target: ATXN1; (+) strand; PAM type: YTN; PAM sequence: TTG
aagctagagacattcttata

SEQ ID NO: 308928 - DNA, 20 bp, Artificial Sequence
  Description of Artificial Sequence: Synthetic oligonucleotide
  Target: ATXN1; (+) strand; PAM type: YTN; PAM sequence: CTA
gagacattcttatatcatta

SEQ ID NO: 308929 - DNA, 20 bp, Artificial Sequence
  Description of Artificial Sequence: Synthetic oligonucleotide
  Target: ATXN1; (+) strand; PAM type: YTN; PAM sequence: TTC
ttatatcattagtaacaatg

SEQ ID NO: 308930 - DNA, 20 bp, Artificial Sequence
  Description of Artificial Sequence: Synthetic oligonucleotide
  Target: ATXN1; (+) strand; PAM type: YTN; PAM sequence: CTT
atatcattagtaacaatgta

SEQ ID NO: 308931 - DNA, 20 bp, Artificial Sequence
  Description of Artificial Sequence: Synthetic oligonucleotide
  Target: ATXN1; (+) strand; PAM type: YTN; PAM sequence: TTA
tatcattagtaacaatgtaa

SEQ ID NO: 308932 - DNA, 20 bp, Artificial Sequence
  Description of Artificial Sequence: Synthetic oligonucleotide
  Target: ATXN1; (+) strand; PAM type: YTN; PAM sequence: TTA
gtaacaatgtaaattggtac

SEQ ID NO: 308933 - DNA, 20 bp, Artificial Sequence
  Description of Artificial Sequence: Synthetic oligonucleotide
  Target: ATXN1; (+) strand; PAM type: YTN; PAM sequence: TTG
gtacagccttttagaaagca

SEQ ID NO: 308934 - DNA, 20 bp, Artificial Sequence
  Description of Artificial Sequence: Synthetic oligonucleotide
  Target: ATXN1; (+) strand; PAM type: YTN; PAM sequence: CTT
ttagaaagcaattcagagca

SEQ ID NO: 308935 - DNA, 20 bp, Artificial Sequence
  Description of Artificial Sequence: Synthetic oligonucleotide
  Target: ATXN1; (+) strand; PAM type: YTN; PAM sequence: TTT
tagaaagcaattcagagcaa

SEQ ID NO: 308936 - DNA, 20 bp, Artificial Sequence
  Description of Artificial Sequence: Synthetic oligonucleotide
  Target: ATXN1; (+) strand; PAM type: YTN; PAM sequence: TTT
agaaagcaattcagagcaag

SEQ ID NO: 308937 - DNA, 20 bp, Artificial Sequence
  Description of Artificial Sequence: Synthetic oligonucleotide
  Target: ATXN1; (+) strand; PAM type: YTN; PAM sequence: TTA
gaaagcaattcagagcaagc

SEQ ID NO: 308938 - DNA, 20 bp, Artificial Sequence
  Description of Artificial Sequence: Synthetic oligonucleotide
  Target: ATXN1; (+) strand; PAM type: YTN; PAM sequence: TTC
agagcaagctccctctaact

SEQ ID NO: 308939 - DNA, 20 bp, Artificial Sequence
  Description of Artificial Sequence: Synthetic oligonucleotide
  Target: ATXN1; (+) strand; PAM type: YTN; PAM sequence: CTC
cctctaacttagtattgagc

SEQ ID NO: 308940 - DNA, 20 bp, Artificial Sequence
  Description of Artificial Sequence: Synthetic oligonucleotide
  Target: ATXN1; (+) strand; PAM type: YTN; PAM sequence: CTC
taacttagtattgagccttc

SEQ ID NO: 308941 - DNA, 20 bp, Artificial Sequence
  Description of Artificial Sequence: Synthetic oligonucleotide
  Target: ATXN1; (+) strand; PAM type: YTN; PAM sequence: CTA
acttagtattgagccttctg

SEQ ID NO: 308942 - DNA, 20 bp, Artificial Sequence
  Description of Artificial Sequence: Synthetic oligonucleotide
  Target: ATXN1; (+) strand; PAM type: YTN; PAM sequence: CTT
agtattgagccttctgatgt

SEQ ID NO: 308943 - DNA, 20 bp, Artificial Sequence
  Description of Artificial Sequence: Synthetic oligonucleotide
  Target: ATXN1; (+) strand; PAM type: YTN; PAM sequence: TTA
gtattgagccttctgatgtg

SEQ ID NO: 308944 - DNA, 20 bp, Artificial Sequence
  Description of Artificial Sequence: Synthetic oligonucleotide
  Target: ATXN1; (+) strand; PAM type: YTN; PAM sequence: TTG
agccttctgatgtgagtgtg

SEQ ID NO: 308945 - DNA, 20 bp, Artificial Sequence
  Description of Artificial Sequence: Synthetic oligonucleotide
  Target: ATXN1; (+) strand; PAM type: YTN; PAM sequence: CTT
ctgatgtgagtgtgtcctcg

SEQ ID NO: 308946 - DNA, 20 bp, Artificial Sequence
  Description of Artificial Sequence: Synthetic oligonucleotide
  Target: ATXN1; (+) strand; PAM type: YTN; PAM sequence: TTC
tgatgtgagtgtgtcctcgg

SEQ ID NO: 308947 - DNA, 20 bp, Artificial Sequence
  Description of Artificial Sequence: Synthetic oligonucleotide
  Target: ATXN1; (+) strand; PAM type: YTN; PAM sequence: CTG
atgtgagtgtgtcctcggta

SEQ ID NO: 308948 - DNA, 20 bp, Artificial Sequence
  Description of Artificial Sequence: Synthetic oligonucleotide
  Target: ATXN1; (+) strand; PAM type: YTN; PAM sequence: CTC
ggtaaatacttgtgtgcaaa

SEQ ID NO: 308949 - DNA, 20 bp, Artificial Sequence
  Description of Artificial Sequence: Synthetic oligonucleotide
  Target: ATXN1; (+) strand; PAM type: YTN; PAM sequence: CTT
gtgtgcaaagacattcgctg

SEQ ID NO: 308950 - DNA, 20 bp, Artificial Sequence
  Description of Artificial Sequence: Synthetic oligonucleotide
  Target: ATXN1; (+) strand; PAM type: YTN; PAM sequence: TTG
tgtgcaaagacattcgctgc

SEQ ID NO: 308951 - DNA, 20 bp, Artificial Sequence
  Description of Artificial Sequence: Synthetic oligonucleotide
  Target: ATXN1; (+) strand; PAM type: YTN; PAM sequence: TTC
gctgcggctttacaacagta

SEQ ID NO: 308952 - DNA, 20 bp, Artificial Sequence
  Description of Artificial Sequence: Synthetic oligonucleotide
  Target: ATXN1; (+) strand; PAM type: YTN; PAM sequence: CTG
cggctttacaacagtaaaca

SEQ ID NO: 308953 - DNA, 20 bp, Artificial Sequence
  Description of Artificial Sequence: Synthetic oligonucleotide
  Target: ATXN1; (+) strand; PAM type: YTN; PAM sequence: CTT
tacaacagtaaacaattaga

SEQ ID NO: 308954 - DNA, 20 bp, Artificial Sequence
  Description of Artificial Sequence: Synthetic oligonucleotide
  Target: ATXN1; (+) strand; PAM type: YTN; PAM sequence: TTT
acaacagtaaacaattagaa

SEQ ID NO: 308955 - DNA, 20 bp, Artificial Sequence
  Description of Artificial Sequence: Synthetic oligonucleotide
  Target: ATXN1; (+) strand; PAM type: YTN; PAM sequence: TTA
caacagtaaacaattagaaa

SEQ ID NO: 308956 - DNA, 20 bp, Artificial Sequence
  Description of Artificial Sequence: Synthetic oligonucleotide
  Target: ATXN1; (+) strand; PAM type: YTN; PAM sequence: TTA
gaaacaactcgaatgtccaa

SEQ ID NO: 308957 - DNA, 20 bp, Artificial Sequence
  Description of Artificial Sequence: Synthetic oligonucleotide
  Target: ATXN1; (+) strand; PAM type: YTN; PAM sequence: CTC
gaatgtccaaaaatgatagg

SEQ ID NO: 308958 - DNA, 20 bp, Artificial Sequence
  Description of Artificial Sequence: Synthetic oligonucleotide
  Target: ATXN1; (+) strand; PAM type: YTN; PAM sequence: CTT
aaaaattaagataaaacaac

SEQ ID NO: 308959 - DNA, 20 bp, Artificial Sequence
  Description of Artificial Sequence: Synthetic oligonucleotide
  Target: ATXN1; (+) strand; PAM type: YTN; PAM sequence: TTA
aaaattaagataaaacaacc

SEQ ID NO: 308960 - DNA, 20 bp, Artificial Sequence
  Description of Artificial Sequence: Synthetic oligonucleotide
  Target: ATXN1; (+) strand; PAM type: YTN; PAM sequence: TTA
agataaaacaacctgataga

SEQ ID NO: 308961 - DNA, 20 bp, Artificial Sequence
  Description of Artificial Sequence: Synthetic oligonucleotide
  Target: ATXN1; (+) strand; PAM type: YTN; PAM sequence: CTG
atagaatgttatgtgatcct

SEQ ID NO: 308962 - DNA, 20 bp, Artificial Sequence
  Description of Artificial Sequence: Synthetic oligonucleotide
  Target: ATXN1; (+) strand; PAM type: YTN; PAM sequence: TTA
tgtgatccttgcaaatgaga

SEQ ID NO: 308963 - DNA, 20 bp, Artificial Sequence
  Description of Artificial Sequence: Synthetic oligonucleotide
  Target: ATXN1; (+) strand; PAM type: YTN; PAM sequence: CTT
gcaaatgagaactgtatagc

SEQ ID NO: 308964 - DNA, 20 bp, Artificial Sequence
  Description of Artificial Sequence: Synthetic oligonucleotide
  Target: ATXN1; (+) strand; PAM type: YTN; PAM sequence: TTG
caaatgagaactgtatagct

SEQ ID NO: 308965 - DNA, 20 bp, Artificial Sequence
  Description of Artificial Sequence: Synthetic oligonucleotide
  Target: ATXN1; (+) strand; PAM type: YTN; PAM sequence: CTG
tatagctgaagttactaaga

SEQ ID NO: 308966 - DNA, 20 bp, Artificial Sequence
  Description of Artificial Sequence: Synthetic oligonucleotide
  Target: ATXN1; (+) strand; PAM type: YTN; PAM sequence: CTG
aagttactaagaatgtttat

SEQ ID NO: 308967 - DNA, 20 bp, Artificial Sequence
  Description of Artificial Sequence: Synthetic oligonucleotide
  Target: ATXN1; (+) strand; PAM type: YTN; PAM sequence: TTA
ctaagaatgtttatgctaaa

SEQ ID NO: 308968 - DNA, 20 bp, Artificial Sequence
  Description of Artificial Sequence: Synthetic oligonucleotide
  Target: ATXN1; (+) strand; PAM type: YTN; PAM sequence: CTA
agaatgtttatgctaaatgg

SEQ ID NO: 308969 - DNA, 20 bp, Artificial Sequence
  Description of Artificial Sequence: Synthetic oligonucleotide
  Target: ATXN1; (+) strand; PAM type: YTN; PAM sequence: TTT
atgctaaatgggaaacacaa

SEQ ID NO: 308970 - DNA, 20 bp, Artificial Sequence
  Description of Artificial Sequence: Synthetic oligonucleotide
  Target: ATXN1; (+) strand; PAM type: YTN; PAM sequence: TTA
tgctaaatgggaaacacaaa

SEQ ID NO: 308971 - DNA, 20 bp, Artificial Sequence
  Description of Artificial Sequence: Synthetic oligonucleotide
  Target: ATXN1; (+) strand; PAM type: YTN; PAM sequence: CTA
aatgggaaacacaaaactga

SEQ ID NO: 308972 - DNA, 20 bp, Artificial Sequence
  Description of Artificial Sequence: Synthetic oligonucleotide
  Target: ATXN1; (+) strand; PAM type: YTN; PAM sequence: CTG
aaaaaaagatataagttaca

SEQ ID NO: 308973 - DNA, 20 bp, Artificial Sequence
  Description of Artificial Sequence: Synthetic oligonucleotide
  Target: ATXN1; (+) strand; PAM type: YTN; PAM sequence: TTA
catcatcaagaactaaaaaa

SEQ ID NO: 308974 - DNA, 20 bp, Artificial Sequence
  Description of Artificial Sequence: Synthetic oligonucleotide
  Target: ATXN1; (+) strand; PAM type: YTN; PAM sequence: CTA
aaaaacaacacataaaaatg

SEQ ID NO: 308975 - DNA, 20 bp, Artificial Sequence
  Description of Artificial Sequence: Synthetic oligonucleotide
  Target: ATXN1; (+) strand; PAM type: YTN; PAM sequence: CTT
gatttatggactggaatggt

SEQ ID NO: 308976 - DNA, 20 bp, Artificial Sequence
  Description of Artificial Sequence: Synthetic oligonucleotide
  Target: ATXN1; (+) strand; PAM type: YTN; PAM sequence: TTG
atttatggactggaatggtg

SEQ ID NO: 308977 - DNA, 20 bp, Artificial Sequence
  Description of Artificial Sequence: Synthetic oligonucleotide
  Target: ATXN1; (+) strand; PAM type: YTN; PAM sequence: TTT
atggactggaatggtggaat

SEQ ID NO: 308978 - DNA, 20 bp, Artificial Sequence
  Description of Artificial Sequence: Synthetic oligonucleotide
  Target: ATXN1; (+) strand; PAM type: YTN; PAM sequence: TTA
tggactggaatggtggaatc

SEQ ID NO: 308979 - DNA, 20 bp, Artificial Sequence
  Description of Artificial Sequence: Synthetic oligonucleotide
  Target: ATXN1; (+) strand; PAM type: YTN; PAM sequence: CTG
gaatggtggaatcaaaggga

SEQ ID NO: 308980 - DNA, 20 bp, Artificial Sequence
  Description of Artificial Sequence: Synthetic oligonucleotide
  Target: ATXN1; (+) strand; PAM type: YTN; PAM sequence: CTT
ttgcttttattggctttcct

SEQ ID NO: 308981 - DNA, 20 bp, Artificial Sequence
  Description of Artificial Sequence: Synthetic oligonucleotide
  Target: ATXN1; (+) strand; PAM type: YTN; PAM sequence: TTT
tgcttttattggctttcctt

SEQ ID NO: 308982 - DNA, 20 bp, Artificial Sequence
  Description of Artificial Sequence: Synthetic oligonucleotide
  Target: ATXN1; (+) strand; PAM type: YTN; PAM sequence: TTT
gcttttattggctttccttt

SEQ ID NO: 308983 - DNA, 20 bp, Artificial Sequence
  Description of Artificial Sequence: Synthetic oligonucleotide
  Target: ATXN1; (+) strand; PAM type: YTN; PAM sequence: TTG
cttttattggctttccttta

SEQ ID NO: 308984 - DNA, 20 bp, Artificial Sequence
  Description of Artificial Sequence: Synthetic oligonucleotide
  Target: ATXN1; (+) strand; PAM type: YTN; PAM sequence: CTT
ttattggctttcctttatta

SEQ ID NO: 308985 - DNA, 20 bp, Artificial Sequence
  Description of Artificial Sequence: Synthetic oligonucleotide
  Target: ATXN1; (+) strand; PAM type: YTN; PAM sequence: TTT
tattggctttcctttattat

SEQ ID NO: 308986 - DNA, 20 bp, Artificial Sequence
  Description of Artificial Sequence: Synthetic oligonucleotide
  Target: ATXN1; (+) strand; PAM type: YTN; PAM sequence: TTT
attggctttcctttattatt

SEQ ID NO: 308987 - DNA, 20 bp, Artificial Sequence
  Description of Artificial Sequence: Synthetic oligonucleotide
  Target: ATXN1; (+) strand; PAM type: YTN; PAM sequence: TTA
ttggctttcctttattattg

SEQ ID NO: 308988 - DNA, 20 bp, Artificial Sequence
  Description of Artificial Sequence: Synthetic oligonucleotide
  Target: ATXN1; (+) strand; PAM type: YTN; PAM sequence: TTG
gctttcctttattattgtaa

SEQ ID NO: 308989 - DNA, 20 bp, Artificial Sequence
  Description of Artificial Sequence: Synthetic oligonucleotide
  Target: ATXN1; (+) strand; PAM type: YTN; PAM sequence: CTT
tcctttattattgtaaggtt

SEQ ID NO: 308990 - DNA, 20 bp, Artificial Sequence
  Description of Artificial Sequence: Synthetic oligonucleotide
  Target: ATXN1; (+) strand; PAM type: YTN; PAM sequence: TTT
cctttattattgtaaggttt

SEQ ID NO: 308991 - DNA, 20 bp, Artificial Sequence
  Description of Artificial Sequence: Synthetic oligonucleotide
  Target: ATXN1; (+) strand; PAM type: YTN; PAM sequence: TTC
ctttattattgtaaggtttg

SEQ ID NO: 308992 - DNA, 20 bp, Artificial Sequence
  Description of Artificial Sequence: Synthetic oligonucleotide
  Target: ATXN1; (+) strand; PAM type: YTN; PAM sequence: CTT
tattattgtaaggtttgggc

SEQ ID NO: 308993 - DNA, 20 bp, Artificial Sequence
  Description of Artificial Sequence: Synthetic oligonucleotide
  Target: ATXN1; (+) strand; PAM type: YTN; PAM sequence: TTT
attattgtaaggtttgggca

SEQ ID NO: 308994 - DNA, 20 bp, Artificial Sequence
  Description of Artificial Sequence: Synthetic oligonucleotide
  Target: ATXN1; (+) strand; PAM type: YTN; PAM sequence: TTA
ttattgtaaggtttgggcaa

SEQ ID NO: 308995 - DNA, 20 bp, Artificial Sequence
  Description of Artificial Sequence: Synthetic oligonucleotide
  Target: ATXN1; (+) strand; PAM type: YTN; PAM sequence: TTA
ttgtaaggtttgggcaatac

SEQ ID NO: 308996 - DNA, 20 bp, Artificial Sequence
  Description of Artificial Sequence: Synthetic oligonucleotide
  Target: ATXN1; (+) strand; PAM type: YTN; PAM sequence: TTG
taaggtttgggcaatacatg

SEQ ID NO: 308997 - DNA, 20 bp, Artificial Sequence
  Description of Artificial Sequence: Synthetic oligonucleotide
  Target: ATXN1; (+) strand; PAM type: YTN; PAM sequence: TTT
gggcaatacatgtttaaaaa

SEQ ID NO: 308998 - DNA, 20 bp, Artificial Sequence
  Description of Artificial Sequence: Synthetic oligonucleotide
  Target: ATXN1; (+) strand; PAM type: YTN; PAM sequence: TTG
ggcaatacatgtttaaaaac

SEQ ID NO: 308999 - DNA, 20 bp, Artificial Sequence
  Description of Artificial Sequence: Synthetic oligonucleotide
  Target: ATXN1; (+) strand; PAM type: YTN; PAM sequence: TTT
aaaaacatggtatttttatc

SEQ ID NO: 309000 - DNA, 20 bp, Artificial Sequence
  Description of Artificial Sequence: Synthetic oligonucleotide
  Target: ATXN1; (+) strand; PAM type: YTN; PAM sequence: TTA
aaaacatggtatttttatca

SEQ ID NO: 309001 - DNA, 20 bp, Artificial Sequence
  Description of Artificial Sequence: Synthetic oligonucleotide
  Target: ATXN1; (+) strand; PAM type: YTN; PAM sequence: TTT
ttatcagtcatgtgtagtaa

SEQ ID NO: 309002 - DNA, 20 bp, Artificial Sequence
  Description of Artificial Sequence: Synthetic oligonucleotide
  Target: ATXN1; (+) strand; PAM type: YTN; PAM sequence: TTT
tatcagtcatgtgtagtaaa

SEQ ID NO: 309003 - DNA, 20 bp, Artificial Sequence
  Description of Artificial Sequence: Synthetic oligonucleotide
  Target: ATXN1; (+) strand; PAM type: YTN; PAM sequence: TTT
atcagtcatgtgtagtaaac

SEQ ID NO: 309004 - DNA, 20 bp, Artificial Sequence
  Description of Artificial Sequence: Synthetic oligonucleotide
  Target: ATXN1; (+) strand; PAM type: YTN; PAM sequence: TTA
tcagtcatgtgtagtaaaca

SEQ ID NO: 309005 - DNA, 20 bp, Artificial Sequence
  Description of Artificial Sequence: Synthetic oligonucleotide
  Target: ATXN1; (+) strand; PAM type: YTN; PAM sequence: CTC
ttttctgtagagcagagcta

SEQ ID NO: 309006 - DNA, 20 bp, Artificial Sequence
  Description of Artificial Sequence: Synthetic oligonucleotide
  Target: ATXN1; (+) strand; PAM type: YTN; PAM sequence: CTT
ttctgtagagcagagctacc

SEQ ID NO: 309007 - DNA, 20 bp, Artificial Sequence
  Description of Artificial Sequence: Synthetic oligonucleotide
  Target: ATXN1; (+) strand; PAM type: YTN; PAM sequence: TTT
tctgtagagcagagctacct

SEQ ID NO: 309008 - DNA, 20 bp, Artificial Sequence
  Description of Artificial Sequence: Synthetic oligonucleotide
  Target: ATXN1; (+) strand; PAM type: YTN; PAM sequence: TTT
ctgtagagcagagctacctg

SEQ ID NO: 309009 - DNA, 20 bp, Artificial Sequence
  Description of Artificial Sequence: Synthetic oligonucleotide
  Target: ATXN1; (+) strand; PAM type: YTN; PAM sequence: TTC
tgtagagcagagctacctgc

SEQ ID NO: 309010 - DNA, 20 bp, Artificial Sequence
  Description of Artificial Sequence: Synthetic oligonucleotide
  Target: ATXN1; (+) strand; PAM type: YTN; PAM sequence: CTG
tagagcagagctacctgcgg

SEQ ID NO: 309011 - DNA, 20 bp, Artificial Sequence
  Description of Artificial Sequence: Synthetic oligonucleotide
  Target: ATXN1; (+) strand; PAM type: YTN; PAM sequence: CTA
cctgcggaaaacgtcactgc

SEQ ID NO: 309012 - DNA, 20 bp, Artificial Sequence
  Description of Artificial Sequence: Synthetic oligonucleotide
  Target: ATXN1; (+) strand; PAM type: YTN; PAM sequence: CTG
cggaaaacgtcactgccagg

SEQ ID NO: 309013 - DNA, 20 bp, Artificial Sequence
  Description of Artificial Sequence: Synthetic oligonucleotide
  Target: ATXN1; (+) strand; PAM type: YTN; PAM sequence: CTG
ccaggttagtggagggtgct

SEQ ID NO: 309014 - DNA, 20 bp, Artificial Sequence
  Description of Artificial Sequence: Synthetic oligonucleotide
  Target: ATXN1; (+) strand; PAM type: YTN; PAM sequence: TTA
gtggagggtgcttagtcctt

SEQ ID NO: 309015 - DNA, 20 bp, Artificial Sequence
  Description of Artificial Sequence: Synthetic oligonucleotide
  Target: ATXN1; (+) strand; PAM type: YTN; PAM sequence: CTT
agtccttcccaagagctacc

SEQ ID NO: 309016 - DNA, 20 bp, Artificial Sequence
  Description of Artificial Sequence: Synthetic oligonucleotide
  Target: ATXN1; (+) strand; PAM type: YTN; PAM sequence: TTA
gtccttcccaagagctacct

SEQ ID NO: 309017 - DNA, 20 bp, Artificial Sequence
  Description of Artificial Sequence: Synthetic oligonucleotide
  Target: ATXN1; (+) strand; PAM type: YTN; PAM sequence: CTT
cccaagagctacctgcagaa

SEQ ID NO: 309018 - DNA, 20 bp, Artificial Sequence
  Description of Artificial Sequence: Synthetic oligonucleotide
  Target: ATXN1; (+) strand; PAM type: YTN; PAM sequence: TTC
ccaagagctacctgcagaaa

SEQ ID NO: 309019 - DNA, 20 bp, Artificial Sequence
  Description of Artificial Sequence: Synthetic oligonucleotide
  Target: ATXN1; (+) strand; PAM type: YTN; PAM sequence: CTA
cctgcagaaaacgtcactga

SEQ ID NO: 309020 - DNA, 20 bp, Artificial Sequence
  Description of Artificial Sequence: Synthetic oligonucleotide
  Target: ATXN1; (+) strand; PAM type: YTN; PAM sequence: CTG
cagaaaacgtcactgacagg

SEQ ID NO: 309021 - DNA, 20 bp, Artificial Sequence
  Description of Artificial Sequence: Synthetic oligonucleotide
  Target: ATXN1; (+) strand; PAM type: YTN; PAM sequence: CTG
acaggttagtggagggtgct

SEQ ID NO: 309022 - DNA, 20 bp, Artificial Sequence
  Description of Artificial Sequence: Synthetic oligonucleotide
  Target: ATXN1; (+) strand; PAM type: YTN; PAM sequence: TTA
gtggagggtgcttagtcctt

SEQ ID NO: 309023 - DNA, 20 bp, Artificial Sequence
  Description of Artificial Sequence: Synthetic oligonucleotide
  Target: ATXN1; (+) strand; PAM type: YTN; PAM sequence: CTT
agtccttcccaaatttcaaa

SEQ ID NO: 309024 - DNA, 20 bp, Artificial Sequence
  Description of Artificial Sequence: Synthetic oligonucleotide
  Target: ATXN1; (+) strand; PAM type: YTN; PAM sequence: TTA
gtccttcccaaatttcaaag

SEQ ID NO: 309025 - DNA, 20 bp, Artificial Sequence
  Description of Artificial Sequence: Synthetic oligonucleotide
  Target: ATXN1; (+) strand; PAM type: YTN; PAM sequence: CTT
cccaaatttcaaaggtcctt

SEQ ID NO: 309026 - DNA, 20 bp, Artificial Sequence
  Description of Artificial Sequence: Synthetic oligonucleotide
  Target: ATXN1; (+) strand; PAM type: YTN; PAM sequence: TTC
ccaaatttcaaaggtccttt

SEQ ID NO: 309027 - DNA, 20 bp, Artificial Sequence
  Description of Artificial Sequence: Synthetic oligonucleotide
  Target: ATXN1; (+) strand; PAM type: YTN; PAM sequence: TTT
caaaggtccttttgagattc

SEQ ID NO: 309028 - DNA, 20 bp, Artificial Sequence
  Description of Artificial Sequence: Synthetic oligonucleotide
  Target: ATXN1; (+) strand; PAM type: YTN; PAM sequence: TTC
aaaggtccttttgagattca

SEQ ID NO: 309029 - DNA, 20 bp, Artificial Sequence
  Description of Artificial Sequence: Synthetic oligonucleotide
  Target: ATXN1; (+) strand; PAM type: YTN; PAM sequence: CTT
ttgagattcaaactctgcct

SEQ ID NO: 309030 - DNA, 20 bp, Artificial Sequence
  Description of Artificial Sequence: Synthetic oligonucleotide
  Target: ATXN1; (+) strand; PAM type: YTN; PAM sequence: TTT
tgagattcaaactctgccta

SEQ ID NO: 309031 - DNA, 20 bp, Artificial Sequence
  Description of Artificial Sequence: Synthetic oligonucleotide
  Target: ATXN1; (+) strand; PAM type: YTN; PAM sequence: TTT
gagattcaaactctgcctac

SEQ ID NO: 309032 - DNA, 20 bp, Artificial Sequence
  Description of Artificial Sequence: Synthetic oligonucleotide
  Target: ATXN1; (+) strand; PAM type: YTN; PAM sequence: TTG
agattcaaactctgcctact

SEQ ID NO: 309033 - DNA, 20 bp, Artificial Sequence
  Description of Artificial Sequence: Synthetic oligonucleotide
  Target: ATXN1; (+) strand; PAM type: YTN; PAM sequence: TTC
aaactctgcctactaaaact

SEQ ID NO: 309034 - DNA, 20 bp, Artificial Sequence
  Description of Artificial Sequence: Synthetic oligonucleotide
  Target: ATXN1; (+) strand; PAM type: YTN; PAM sequence: CTC
tgcctactaaaactggctgc

SEQ ID NO: 309035 - DNA, 20 bp, Artificial Sequence
  Description of Artificial Sequence: Synthetic oligonucleotide
  Target: ATXN1; (+) strand; PAM type: YTN; PAM sequence: CTG
cctactaaaactggctgctc

SEQ ID NO: 309036 - DNA, 20 bp, Artificial Sequence
  Description of Artificial Sequence: Synthetic oligonucleotide
  Target: ATXN1; (+) strand; PAM type: YTN; PAM sequence: CTA
ctaaaactggctgctctgag

SEQ ID NO: 309037 - DNA, 20 bp, Artificial Sequence
  Description of Artificial Sequence: Synthetic oligonucleotide
  Target: ATXN1; (+) strand; PAM type: YTN; PAM sequence: CTA
aaactggctgctctgagaag

SEQ ID NO: 309038 - DNA, 20 bp, Artificial Sequence
  Description of Artificial Sequence: Synthetic oligonucleotide
  Target: ATXN1; (+) strand; PAM type: YTN; PAM sequence: CTG
gctgctctgagaagctcctc

SEQ ID NO: 309039 - DNA, 20 bp, Artificial Sequence
  Description of Artificial Sequence: Synthetic oligonucleotide
  Target: ATXN1; (+) strand; PAM type: YTN; PAM sequence: CTG
ctctgagaagctcctcctac

SEQ ID NO: 309040 - DNA, 20 bp, Artificial Sequence
  Description of Artificial Sequence: Synthetic oligonucleotide
  Target: ATXN1; (+) strand; PAM type: YTN; PAM sequence: CTC
tgagaagctcctcctaccct

SEQ ID NO: 309041 - DNA, 20 bp, Artificial Sequence
  Description of Artificial Sequence: Synthetic oligonucleotide
  Target: ATXN1; (+) strand; PAM type: YTN; PAM sequence: CTG
agaagctcctcctaccctga

SEQ ID NO: 309042 - DNA, 20 bp, Artificial Sequence
  Description of Artificial Sequence: Synthetic oligonucleotide
  Target: ATXN1; (+) strand; PAM type: YTN; PAM sequence: CTC
ctcctaccctgactatacct

SEQ ID NO: 309043 - DNA, 20 bp, Artificial Sequence
  Description of Artificial Sequence: Synthetic oligonucleotide
  Target: ATXN1; (+) strand; PAM type: YTN; PAM sequence: CTC
ctaccctgactatacctcaa

SEQ ID NO: 309044 - DNA, 20 bp, Artificial Sequence
  Description of Artificial Sequence: Synthetic oligonucleotide
  Target: ATXN1; (+) strand; PAM type: YTN; PAM sequence: CTA
ccctgactatacctcaaatg

SEQ ID NO: 309045 - DNA, 20 bp, Artificial Sequence
  Description of Artificial Sequence: Synthetic oligonucleotide
  Target: ATXN1; (+) strand; PAM type: YTN; PAM sequence: CTG
actatacctcaaatgcagca

SEQ ID NO: 309046 - DNA, 20 bp, Artificial Sequence
  Description of Artificial Sequence: Synthetic oligonucleotide
  Target: ATXN1; (+) strand; PAM type: YTN; PAM sequence: CTA
tacctcaaatgcagcacttt

SEQ ID NO: 309047 - DNA, 20 bp, Artificial Sequence
  Description of Artificial Sequence: Synthetic oligonucleotide
  Target: ATXN1; (+) strand; PAM type: YTN; PAM sequence: CTC
aaatgcagcactttcctttg

SEQ ID NO: 309048 - DNA, 20 bp, Artificial Sequence
  Description of Artificial Sequence: Synthetic oligonucleotide
  Target: ATXN1; (+) strand; PAM type: YTN; PAM sequence: CTT
tcctttgttcttgctttttt

SEQ ID NO: 309049 - DNA, 20 bp, Artificial Sequence
  Description of Artificial Sequence: Synthetic oligonucleotide
  Target: ATXN1; (+) strand; PAM type: YTN; PAM sequence: TTT
cctttgttcttgcttttttt

SEQ ID NO: 309050 - DNA, 20 bp, Artificial Sequence
  Description of Artificial Sequence: Synthetic oligonucleotide
  Target: ATXN1; (+) strand; PAM type: YTN; PAM sequence: TTC
ctttgttcttgcttttttta

SEQ ID NO: 309051 - DNA, 20 bp, Artificial Sequence
  Description of Artificial Sequence: Synthetic oligonucleotide
  Target: ATXN1; (+) strand; PAM type: YTN; PAM sequence: CTT
tgttcttgctttttttattc

SEQ ID NO: 309052 - DNA, 20 bp, Artificial Sequence
  Description of Artificial Sequence: Synthetic oligonucleotide
  Target: ATXN1; (+) strand; PAM type: YTN; PAM sequence: TTT
gttcttgctttttttattca

SEQ ID NO: 309053 - DNA, 20 bp, Artificial Sequence
  Description of Artificial Sequence: Synthetic oligonucleotide
  Target: ATXN1; (+) strand; PAM type: YTN; PAM sequence: TTG
ttcttgctttttttattcag

SEQ ID NO: 309054 - DNA, 20 bp, Artificial Sequence
  Description of Artificial Sequence: Synthetic oligonucleotide
  Target: ATXN1; (+) strand; PAM type: YTN; PAM sequence: TTC
ttgctttttttattcagctc

SEQ ID NO: 309055 - DNA, 20 bp, Artificial Sequence
  Description of Artificial Sequence: Synthetic oligonucleotide
  Target: ATXN1; (+) strand; PAM type: YTN; PAM sequence: CTT
gctttttttattcagctctt

SEQ ID NO: 309056 - DNA, 20 bp, Artificial Sequence
  Description of Artificial Sequence: Synthetic oligonucleotide
  Target: ATXN1; (+) strand; PAM type: YTN; PAM sequence: TTG
ctttttttattcagctctta

SEQ ID NO: 309057 - DNA, 20 bp, Artificial Sequence
  Description of Artificial Sequence: Synthetic oligonucleotide
  Target: ATXN1; (+) strand; PAM type: YTN; PAM sequence: CTT
tttttattcagctcttaaat

SEQ ID NO: 309058 - DNA, 20 bp, Artificial Sequence
  Description of Artificial Sequence: Synthetic oligonucleotide
  Target: ATXN1; (+) strand; PAM type: YTN; PAM sequence: TTT
ttttattcagctcttaaatg

SEQ ID NO: 309059 - DNA, 20 bp, Artificial Sequence
  Description of Artificial Sequence: Synthetic oligonucleotide
  Target: ATXN1; (+) strand; PAM type: YTN; PAM sequence: TTT
tttattcagctcttaaatgc

SEQ ID NO: 309060 - DNA, 20 bp, Artificial Sequence
  Description of Artificial Sequence: Synthetic oligonucleotide
  Target: ATXN1; (+) strand; PAM type: YTN; PAM sequence: TTT
ttattcagctcttaaatgct

SEQ ID NO: 309061 - DNA, 20 bp, Artificial Sequence
  Description of Artificial Sequence: Synthetic oligonucleotide
  Target: ATXN1; (+) strand; PAM type: YTN; PAM sequence: TTT
tattcagctcttaaatgcta

SEQ ID NO: 309062 - DNA, 20 bp, Artificial Sequence
  Description of Artificial Sequence: Synthetic oligonucleotide
  Target: ATXN1; (+) strand; PAM type: YTN; PAM sequence: TTT
attcagctcttaaatgctat

SEQ ID NO: 309063 - DNA, 20 bp, Artificial Sequence
  Description of Artificial Sequence: Synthetic oligonucleotide
  Target: ATXN1; (+) strand; PAM type: YTN; PAM sequence: TTA
ttcagctcttaaatgctatg

SEQ ID NO: 309064 - DNA, 20 bp, Artificial Sequence
  Description of Artificial Sequence: Synthetic oligonucleotide
  Target: ATXN1; (+) strand; PAM type: YTN; PAM sequence: TTC
agctcttaaatgctatgcct

SEQ ID NO: 309065 - DNA, 20 bp, Artificial Sequence
  Description of Artificial Sequence: Synthetic oligonucleotide
  Target: ATXN1; (+) strand; PAM type: YTN; PAM sequence: CTC
ttaaatgctatgccttccgt

SEQ ID NO: 309066 - DNA, 20 bp, Artificial Sequence
  Description of Artificial Sequence: Synthetic oligonucleotide
  Target: ATXN1; (+) strand; PAM type: YTN; PAM sequence: CTT
aaatgctatgccttccgtgt

SEQ ID NO: 309067 - DNA, 20 bp, Artificial Sequence
  Description of Artificial Sequence: Synthetic oligonucleotide
  Target: ATXN1; (+) strand; PAM type: YTN; PAM sequence: TTA
aatgctatgccttccgtgtg

SEQ ID NO: 309068 - DNA, 20 bp, Artificial Sequence
  Description of Artificial Sequence: Synthetic oligonucleotide
  Target: ATXN1; (+) strand; PAM type: YTN; PAM sequence: CTA
tgccttccgtgtgtgtgtgt

SEQ ID NO: 309069 - DNA, 20 bp, Artificial Sequence
  Description of Artificial Sequence: Synthetic oligonucleotide
  Target: ATXN1; (+) strand; PAM type: YTN; PAM sequence: CTT
ccgtgtgtgtgtgtgtgtgt

SEQ ID NO: 309070 - DNA, 20 bp, Artificial Sequence
  Description of Artificial Sequence: Synthetic oligonucleotide
  Target: ATXN1; (+) strand; PAM type: YTN; PAM sequence: TTC
cgtgtgtgtgtgtgtgtgtg

SEQ ID NO: 309071 - DNA, 20 bp, Artificial Sequence
  Description of Artificial Sequence: Synthetic oligonucleotide
  Target: ATXN1; (+) strand; PAM type: YTN; PAM sequence: CTG
tttttattagttattgagat

SEQ ID NO: 309072 - DNA, 20 bp, Artificial Sequence
  Description of Artificial Sequence: Synthetic oligonucleotide
  Target: ATXN1; (+) strand; PAM type: YTN; PAM sequence: TTT
ttattagttattgagatact

SEQ ID NO: 309073 - DNA, 20 bp, Artificial Sequence
  Description of Artificial Sequence: Synthetic oligonucleotide
  Target: ATXN1; (+) strand; PAM type: YTN; PAM sequence: TTT
tattagttattgagatacta

SEQ ID NO: 309074 - DNA, 20 bp, Artificial Sequence
  Description of Artificial Sequence: Synthetic oligonucleotide
  Target: ATXN1; (+) strand; PAM type: YTN; PAM sequence: TTT
attagttattgagatactac

SEQ ID NO: 309075 - DNA, 20 bp, Artificial Sequence
  Description of Artificial Sequence: Synthetic oligonucleotide
  Target: ATXN1; (+) strand; PAM type: YTN; PAM sequence: TTA
ttagttattgagatactacc

SEQ ID NO: 309076 - DNA, 20 bp, Artificial Sequence
  Description of Artificial Sequence: Synthetic oligonucleotide
  Target: ATXN1; (+) strand; PAM type: YTN; PAM sequence: TTA
gttattgagatactaccata

SEQ ID NO: 309077 - DNA, 20 bp, Artificial Sequence
  Description of Artificial Sequence: Synthetic oligonucleotide
  Target: ATXN1; (+) strand; PAM type: YTN; PAM sequence: TTA
ttgagatactaccataagca

SEQ ID NO: 309078 - DNA, 20 bp, Artificial Sequence
  Description of Artificial Sequence: Synthetic oligonucleotide
  Target: ATXN1; (+) strand; PAM type: YTN; PAM sequence: TTG
agatactaccataagcaaca

SEQ ID NO: 309079 - DNA, 20 bp, Artificial Sequence
  Description of Artificial Sequence: Synthetic oligonucleotide
  Target: ATXN1; (+) strand; PAM type: YTN; PAM sequence: CTA
ccataagcaacatctagaga

SEQ ID NO: 309080 - DNA, 20 bp, Artificial Sequence
  Description of Artificial Sequence: Synthetic oligonucleotide
  Target: ATXN1; (+) strand; PAM type: YTN; PAM sequence: CTA
gagagtgagtgcacatttaa

SEQ ID NO: 309081 - DNA, 20 bp, Artificial Sequence
  Description of Artificial Sequence: Synthetic oligonucleotide
  Target: ATXN1; (+) strand; PAM type: YTN; PAM sequence: TTT
aatctttccagtgattctgt

SEQ ID NO: 309082 - DNA, 20 bp, Artificial Sequence
  Description of Artificial Sequence: Synthetic oligonucleotide
  Target: ATXN1; (+) strand; PAM type: YTN; PAM sequence: TTA
atctttccagtgattctgtg

SEQ ID NO: 309083 - DNA, 20 bp, Artificial Sequence
  Description of Artificial Sequence: Synthetic oligonucleotide
  Target: ATXN1; (+) strand; PAM type: YTN; PAM sequence: CTT
tccagtgattctgtgagtta

SEQ ID NO: 309084 - DNA, 20 bp, Artificial Sequence
  Description of Artificial Sequence: Synthetic oligonucleotide
  Target: ATXN1; (+) strand; PAM type: YTN; PAM sequence: TTT
ccagtgattctgtgagttag

SEQ ID NO: 309085 - DNA, 20 bp, Artificial Sequence
  Description of Artificial Sequence: Synthetic oligonucleotide
  Target: ATXN1; (+) strand; PAM type: YTN; PAM sequence: TTC
cagtgattctgtgagttagg

SEQ ID NO: 309086 - DNA, 20 bp, Artificial Sequence
  Description of Artificial Sequence: Synthetic oligonucleotide
  Target: ATXN1; (+) strand; PAM type: YTN; PAM sequence: TTC
tgtgagttaggtgatattat

SEQ ID NO: 309087 - DNA, 20 bp, Artificial Sequence
  Description of Artificial Sequence: Synthetic oligonucleotide
  Target: ATXN1; (+) strand; PAM type: YTN; PAM sequence: CTG
tgagttaggtgatattatca

SEQ ID NO: 309088 - DNA, 20 bp, Artificial Sequence
  Description of Artificial Sequence: Synthetic oligonucleotide
  Target: ATXN1; (+) strand; PAM type: YTN; PAM sequence: TTA
ggtgatattatcatccccat

SEQ ID NO: 309089 - DNA, 20 bp, Artificial Sequence
  Description of Artificial Sequence: Synthetic oligonucleotide
  Target: ATXN1; (+) strand; PAM type: YTN; PAM sequence: TTA
tcatccccattcaacagatg

SEQ ID NO: 309090 - DNA, 20 bp, Artificial Sequence
  Description of Artificial Sequence: Synthetic oligonucleotide
  Target: ATXN1; (+) strand; PAM type: YTN; PAM sequence: TTC
aacagatgaggaaattgagg

SEQ ID NO: 309091 - DNA, 20 bp, Artificial Sequence
  Description of Artificial Sequence: Synthetic oligonucleotide
  Target: ATXN1; (+) strand; PAM type: YTN; PAM sequence: TTG
aggatcacagatttaaggaa

SEQ ID NO: 309092 - DNA, 20 bp, Artificial Sequence
  Description of Artificial Sequence: Synthetic oligonucleotide
  Target: ATXN1; (+) strand; PAM type: YTN; PAM sequence: TTT
aaggaatgtgacctggacca

SEQ ID NO: 309093 - DNA, 20 bp, Artificial Sequence
  Description of Artificial Sequence: Synthetic oligonucleotide
  Target: ATXN1; (+) strand; PAM type: YTN; PAM sequence: TTA
aggaatgtgacctggaccac

SEQ ID NO: 309094 - DNA, 20 bp, Artificial Sequence
  Description of Artificial Sequence: Synthetic oligonucleotide
  Target: ATXN1; (+) strand; PAM type: YTN; PAM sequence: CTG
gaccacaaagccaggagcca

SEQ ID NO: 309095 - DNA, 20 bp, Artificial Sequence
  Description of Artificial Sequence: Synthetic oligonucleotide
  Target: ATXN1; (+) strand; PAM type: YTN; PAM sequence: TTC
aagcctcaatctccctgact

SEQ ID NO: 309096 - DNA, 20 bp, Artificial Sequence
  Description of Artificial Sequence: Synthetic oligonucleotide
  Target: ATXN1; (+) strand; PAM type: YTN; PAM sequence: CTC
aatctccctgactttaaagc

SEQ ID NO: 309097 - DNA, 20 bp, Artificial Sequence
  Description of Artificial Sequence: Synthetic oligonucleotide
  Target: ATXN1; (+) strand; PAM type: YTN; PAM sequence: CTC
cctgactttaaagccttcat

SEQ ID NO: 309098 - DNA, 20 bp, Artificial Sequence
  Description of Artificial Sequence: Synthetic oligonucleotide
  Target: ATXN1; (+) strand; PAM type: YTN; PAM sequence: CTG
actttaaagccttcattttc

SEQ ID NO: 309099 - DNA, 20 bp, Artificial Sequence
  Description of Artificial Sequence: Synthetic oligonucleotide
  Target: ATXN1; (+) strand; PAM type: YTN; PAM sequence: CTT
taaagccttcattttcaccc

SEQ ID NO: 309100 - DNA, 20 bp, Artificial Sequence
  Description of Artificial Sequence: Synthetic oligonucleotide
  Target: ATXN1; (+) strand; PAM type: YTN; PAM sequence: TTT
aaagccttcattttcaccct

SEQ ID NO: 309101 - DNA, 20 bp, Artificial Sequence
  Description of Artificial Sequence: Synthetic oligonucleotide
  Target: ATXN1; (+) strand; PAM type: YTN; PAM sequence: TTA
aagccttcattttcaccctc

SEQ ID NO: 309102 - DNA, 20 bp, Artificial Sequence
  Description of Artificial Sequence: Synthetic oligonucleotide
  Target: ATXN1; (+) strand; PAM type: YTN; PAM sequence: CTT
cattttcaccctccctctct

SEQ ID NO: 309103 - DNA, 20 bp, Artificial Sequence
  Description of Artificial Sequence: Synthetic oligonucleotide
  Target: ATXN1; (+) strand; PAM type: YTN; PAM sequence: TTC
attttcaccctccctctctg

SEQ ID NO: 309104 - DNA, 20 bp, Artificial Sequence
  Description of Artificial Sequence: Synthetic oligonucleotide
  Target: ATXN1; (+) strand; PAM type: YTN; PAM sequence: TTT
tcaccctccctctctgtcta

SEQ ID NO: 309105 - DNA, 20 bp, Artificial Sequence
  Description of Artificial Sequence: Synthetic oligonucleotide
  Target: ATXN1; (+) strand; PAM type: YTN; PAM sequence: TTT
caccctccctctctgtctat

SEQ ID NO: 309106 - DNA, 20 bp, Artificial Sequence
  Description of Artificial Sequence: Synthetic oligonucleotide
  Target: ATXN1; (+) strand; PAM type: YTN; PAM sequence: TTC
accctccctctctgtctatg

SEQ ID NO: 309107 - DNA, 20 bp, Artificial Sequence
  Description of Artificial Sequence: Synthetic oligonucleotide
  Target: ATXN1; (+) strand; PAM type: YTN; PAM sequence: CTC
cctctctgtctatgaaacaa

SEQ ID NO: 309108 - DNA, 20 bp, Artificial Sequence
  Description of Artificial Sequence: Synthetic oligonucleotide
  Target: ATXN1; (+) strand; PAM type: YTN; PAM sequence: CTC
tctgtctatgaaacaaataa

SEQ ID NO: 309109 - DNA, 20 bp, Artificial Sequence
  Description of Artificial Sequence: Synthetic oligonucleotide
  Target: ATXN1; (+) strand; PAM type: YTN; PAM sequence: CTC
tgtctatgaaacaaataaat

SEQ ID NO: 309110 - DNA, 20 bp, Artificial Sequence
  Description of Artificial Sequence: Synthetic oligonucleotide
  Target: ATXN1; (+) strand; PAM type: YTN; PAM sequence: CTG
tctatgaaacaaataaatta

SEQ ID NO: 309111 - DNA, 20 bp, Artificial Sequence
  Description of Artificial Sequence: Synthetic oligonucleotide
  Target: ATXN1; (+) strand; PAM type: YTN; PAM sequence: CTA
tgaaacaaataaattaaaac

SEQ ID NO: 309112 - DNA, 20 bp, Artificial Sequence
  Description of Artificial Sequence: Synthetic oligonucleotide
  Target: ATXN1; (+) strand; PAM type: YTN; PAM sequence: TTA
aaacaacaaaccctctcaaa

SEQ ID NO: 309113 - DNA, 20 bp, Artificial Sequence
  Description of Artificial Sequence: Synthetic oligonucleotide
  Target: ATXN1; (+) strand; PAM type: YTN; PAM sequence: CTC
tcaaatgtcaccttttctat

SEQ ID NO: 309114 - DNA, 20 bp, Artificial Sequence
  Description of Artificial Sequence: Synthetic oligonucleotide
  Target: ATXN1; (+) strand; PAM type: YTN; PAM sequence: CTC
aaatgtcaccttttctattt

SEQ ID NO: 309115 - DNA, 20 bp, Artificial Sequence
  Description of Artificial Sequence: Synthetic oligonucleotide
  Target: ATXN1; (+) strand; PAM type: YTN; PAM sequence: CTT
ttctatttgcactagctgcc

SEQ ID NO: 309116 - DNA, 20 bp, Artificial Sequence
  Description of Artificial Sequence: Synthetic oligonucleotide
  Target: ATXN1; (+) strand; PAM type: YTN; PAM sequence: TTT
tctatttgcactagctgcct

SEQ ID NO: 309117 - DNA, 20 bp, Artificial Sequence
  Description of Artificial Sequence: Synthetic oligonucleotide
  Target: ATXN1; (+) strand; PAM type: YTN; PAM sequence: TTT
ctatttgcactagctgccta

SEQ ID NO: 309118 - DNA, 20 bp, Artificial Sequence
  Description of Artificial Sequence: Synthetic oligonucleotide
  Target: ATXN1; (+) strand; PAM type: YTN; PAM sequence: TTC
tatttgcactagctgcctaa

SEQ ID NO: 309119 - DNA, 20 bp, Artificial Sequence
  Description of Artificial Sequence: Synthetic oligonucleotide
  Target: ATXN1; (+) strand; PAM type: YTN; PAM sequence: CTA
tttgcactagctgcctaaag

SEQ ID NO: 309120 - DNA, 20 bp, Artificial Sequence
  Description of Artificial Sequence: Synthetic oligonucleotide
  Target: ATXN1; (+) strand; PAM type: YTN; PAM sequence: TTT
gcactagctgcctaaagaaa

SEQ ID NO: 309121 - DNA, 20 bp, Artificial Sequence
  Description of Artificial Sequence: Synthetic oligonucleotide
  Target: ATXN1; (+) strand; PAM type: YTN; PAM sequence: TTG
cactagctgcctaaagaaac

SEQ ID NO: 309122 - DNA, 20 bp, Artificial Sequence
  Description of Artificial Sequence: Synthetic oligonucleotide
  Target: ATXN1; (+) strand; PAM type: YTN; PAM sequence: CTA
gctgcctaaagaaactatta

SEQ ID NO: 309123 - DNA, 20 bp, Artificial Sequence
  Description of Artificial Sequence: Synthetic oligonucleotide
  Target: ATXN1; (+) strand; PAM type: YTN; PAM sequence: CTG
cctaaagaaactattaataa

SEQ ID NO: 309124 - DNA, 20 bp, Artificial Sequence
  Description of Artificial Sequence: Synthetic oligonucleotide
  Target: ATXN1; (+) strand; PAM type: YTN; PAM sequence: CTA
aagaaactattaataattgc

SEQ ID NO: 309125 - DNA, 20 bp, Artificial Sequence
  Description of Artificial Sequence: Synthetic oligonucleotide
  Target: ATXN1; (+) strand; PAM type: YTN; PAM sequence: CTA
ttaataattgcaatgaatca

SEQ ID NO: 309126 - DNA, 20 bp, Artificial Sequence
  Description of Artificial Sequence: Synthetic oligonucleotide
  Target: ATXN1; (+) strand; PAM type: YTN; PAM sequence: TTA
ataattgcaatgaatcaaga

SEQ ID NO: 309127 - DNA, 20 bp, Artificial Sequence
  Description of Artificial Sequence: Synthetic oligonucleotide
  Target: ATXN1; (+) strand; PAM type: YTN; PAM sequence: TTG
caatgaatcaagaggcatct

SEQ ID NO: 309128 - DNA, 20 bp, Artificial Sequence
  Description of Artificial Sequence: Synthetic oligonucleotide
  Target: ATXN1; (+) strand; PAM type: YTN; PAM sequence: CTG
tatgaactgcttatgaatta

SEQ ID NO: 309129 - DNA, 20 bp, Artificial Sequence
  Description of Artificial Sequence: Synthetic oligonucleotide
  Target: ATXN1; (+) strand; PAM type: YTN; PAM sequence: CTG
cttatgaattaaccaaaaag

SEQ ID NO: 309130 - DNA, 20 bp, Artificial Sequence
  Description of Artificial Sequence: Synthetic oligonucleotide
  Target: ATXN1; (+) strand; PAM type: YTN; PAM sequence: CTT
atgaattaaccaaaaagaca

SEQ ID NO: 309131 - DNA, 20 bp, Artificial Sequence
  Description of Artificial Sequence: Synthetic oligonucleotide
  Target: ATXN1; (+) strand; PAM type: YTN; PAM sequence: TTA
tgaattaaccaaaaagacaa

SEQ ID NO: 309132 - DNA, 20 bp, Artificial Sequence
  Description of Artificial Sequence: Synthetic oligonucleotide
  Target: ATXN1; (+) strand; PAM type: YTN; PAM sequence: TTA
accaaaaagacaaggcaatg

SEQ ID NO: 309133 - DNA, 20 bp, Artificial Sequence
  Description of Artificial Sequence: Synthetic oligonucleotide
  Target: ATXN1; (+) strand; PAM type: YTN; PAM sequence: CTG
cacacactaattgggaaagt

SEQ ID NO: 309134 - DNA, 20 bp, Artificial Sequence
  Description of Artificial Sequence: Synthetic oligonucleotide
  Target: ATXN1; (+) strand; PAM type: YTN; PAM sequence: CTA
attgggaaagttgacgcaga

SEQ ID NO: 309135 - DNA, 20 bp, Artificial Sequence
  Description of Artificial Sequence: Synthetic oligonucleotide
  Target: ATXN1; (+) strand; PAM type: YTN; PAM sequence: TTG
ggaaagttgacgcagaagag

SEQ ID NO: 309136 - DNA, 20 bp, Artificial Sequence
  Description of Artificial Sequence: Synthetic oligonucleotide
  Target: ATXN1; (+) strand; PAM type: YTN; PAM sequence: TTG
acgcagaagagaaaaggaat

SEQ ID NO: 309137 - DNA, 20 bp, Artificial Sequence
  Description of Artificial Sequence: Synthetic oligonucleotide
  Target: ATXN1; (+) strand; PAM type: YTN; PAM sequence: TTA
cctagagactaaaacctgca

SEQ ID NO: 309138 - DNA, 20 bp, Artificial Sequence
  Description of Artificial Sequence: Synthetic oligonucleotide
  Target: ATXN1; (+) strand; PAM type: YTN; PAM sequence: CTA
gagactaaaacctgcacctg

SEQ ID NO: 309139 - DNA, 20 bp, Artificial Sequence
  Description of Artificial Sequence: Synthetic oligonucleotide
  Target: ATXN1; (+) strand; PAM type: YTN; PAM sequence: CTA
aaacctgcacctgcaggtaa

SEQ ID NO: 309140 - DNA, 20 bp, Artificial Sequence
  Description of Artificial Sequence: Synthetic oligonucleotide
  Target: ATXN1; (+) strand; PAM type: YTN; PAM sequence: CTG
cacctgcaggtaaaaccaaa

SEQ ID NO: 309141 - DNA, 20 bp, Artificial Sequence
  Description of Artificial Sequence: Synthetic oligonucleotide
  Target: ATXN1; (+) strand; PAM type: YTN; PAM sequence: CTG
caggtaaaaccaaatgacat

SEQ ID NO: 309142 - DNA, 20 bp, Artificial Sequence
  Description of Artificial Sequence: Synthetic oligonucleotide
  Target: ATXN1; (+) strand; PAM type: YTN; PAM sequence: TTT
ctacttgcaaattaaaagca

SEQ ID NO: 309143 - DNA, 20 bp, Artificial Sequence
  Description of Artificial Sequence: Synthetic oligonucleotide
  Target: ATXN1; (+) strand; PAM type: YTN; PAM sequence: TTC
tacttgcaaattaaaagcag

SEQ ID NO: 309144 - DNA, 20 bp, Artificial Sequence
  Description of Artificial Sequence: Synthetic oligonucleotide
  Target: ATXN1; (+) strand; PAM type: YTN; PAM sequence: CTA
cttgcaaattaaaagcagaa

SEQ ID NO: 309145 - DNA, 20 bp, Artificial Sequence
  Description of Artificial Sequence: Synthetic oligonucleotide
  Target: ATXN1; (+) strand; PAM type: YTN; PAM sequence: CTT
gcaaattaaaagcagaatat

SEQ ID NO: 309146 - DNA, 20 bp, Artificial Sequence
  Description of Artificial Sequence: Synthetic oligonucleotide
  Target: ATXN1; (+) strand; PAM type: YTN; PAM sequence: TTG
caaattaaaagcagaatatg

SEQ ID NO: 309147 - DNA, 20 bp, Artificial Sequence
  Description of Artificial Sequence: Synthetic oligonucleotide
  Target: ATXN1; (+) strand; PAM type: YTN; PAM sequence: TTA
aaagcagaatatggcccttg

SEQ ID NO: 309148 - DNA, 20 bp, Artificial Sequence
  Description of Artificial Sequence: Synthetic oligonucleotide
  Target: ATXN1; (+) strand; PAM type: YTN; PAM sequence: CTT
gatattactgcttagaaaag

SEQ ID NO: 309149 - DNA, 20 bp, Artificial Sequence
  Description of Artificial Sequence: Synthetic oligonucleotide
  Target: ATXN1; (+) strand; PAM type: YTN; PAM sequence: TTG
atattactgcttagaaaagc

SEQ ID NO: 309150 - DNA, 20 bp, Artificial Sequence
  Description of Artificial Sequence: Synthetic oligonucleotide
  Target: ATXN1; (+) strand; PAM type: YTN; PAM sequence: TTA
ctgcttagaaaagcagagct

SEQ ID NO: 309151 - DNA, 20 bp, Artificial Sequence
  Description of Artificial Sequence: Synthetic oligonucleotide
  Target: ATXN1; (+) strand; PAM type: YTN; PAM sequence: CTG
cttagaaaagcagagcttct

SEQ ID NO: 309152 - DNA, 20 bp, Artificial Sequence
  Description of Artificial Sequence: Synthetic oligonucleotide
  Target: ATXN1; (+) strand; PAM type: YTN; PAM sequence: CTT
agaaaagcagagcttctgca

SEQ ID NO: 309153 - DNA, 20 bp, Artificial Sequence
  Description of Artificial Sequence: Synthetic oligonucleotide
  Target: ATXN1; (+) strand; PAM type: YTN; PAM sequence: TTA
gaaaagcagagcttctgcac

SEQ ID NO: 309154 - DNA, 20 bp, Artificial Sequence
  Description of Artificial Sequence: Synthetic oligonucleotide
  Target: ATXN1; (+) strand; PAM type: YTN; PAM sequence: CTT
ctgcactcctcttgcaaaaa

SEQ ID NO: 309155 - DNA, 20 bp, Artificial Sequence
  Description of Artificial Sequence: Synthetic oligonucleotide
  Target: ATXN1; (+) strand; PAM type: YTN; PAM sequence: TTC
tgcactcctcttgcaaaaaa

SEQ ID NO: 309156 - DNA, 20 bp, Artificial Sequence
  Description of Artificial Sequence: Synthetic oligonucleotide
  Target: ATXN1; (+) strand; PAM type: YTN; PAM sequence: CTG
cactcctcttgcaaaaaata

SEQ ID NO: 309157 - DNA, 20 bp, Artificial Sequence
  Description of Artificial Sequence: Synthetic oligonucleotide
  Target: ATXN1; (+) strand; PAM type: YTN; PAM sequence: CTC
ctcttgcaaaaaataatccc

SEQ ID NO: 309158 - DNA, 20 bp, Artificial Sequence
  Description of Artificial Sequence: Synthetic oligonucleotide
  Target: ATXN1; (+) strand; PAM type: YTN; PAM sequence: CTC
ttgcaaaaaataatcccaca

SEQ ID NO: 309159 - DNA, 20 bp, Artificial Sequence
  Description of Artificial Sequence: Synthetic oligonucleotide
  Target: ATXN1; (+) strand; PAM type: YTN; PAM sequence: CTT
gcaaaaaataatcccacaat

SEQ ID NO: 309160 - DNA, 20 bp, Artificial Sequence
  Description of Artificial Sequence: Synthetic oligonucleotide
  Target: ATXN1; (+) strand; PAM type: YTN; PAM sequence: TTG
caaaaaataatcccacaatc

SEQ ID NO: 309161 - DNA, 20 bp, Artificial Sequence
  Description of Artificial Sequence: Synthetic oligonucleotide
  Target: ATXN1; (+) strand; PAM type: YTN; PAM sequence: CTG
aaagattctttccagttata

SEQ ID NO: 309162 - DNA, 20 bp, Artificial Sequence
  Description of Artificial Sequence: Synthetic oligonucleotide
  Target: ATXN1; (+) strand; PAM type: YTN; PAM sequence: TTC
tttccagttatactgcattc

SEQ ID NO: 309163 - DNA, 20 bp, Artificial Sequence
  Description of Artificial Sequence: Synthetic oligonucleotide
  Target: ATXN1; (+) strand; PAM type: YTN; PAM sequence: CTT
tccagttatactgcattcca

SEQ ID NO: 309164 - DNA, 20 bp, Artificial Sequence
  Description of Artificial Sequence: Synthetic oligonucleotide
  Target: ATXN1; (+) strand; PAM type: YTN; PAM sequence: TTT
ccagttatactgcattccac

SEQ ID NO: 309165 - DNA, 20 bp, Artificial Sequence
  Description of Artificial Sequence: Synthetic oligonucleotide
  Target: ATXN1; (+) strand; PAM type: YTN; PAM sequence: TTC
cagttatactgcattccacc

SEQ ID NO: 309166 - DNA, 20 bp, Artificial Sequence
  Description of Artificial Sequence: Synthetic oligonucleotide
  Target: ATXN1; (+) strand; PAM type: YTN; PAM sequence: TTA
tactgcattccacctccaga

SEQ ID NO: 309167 - DNA, 20 bp, Artificial Sequence
  Description of Artificial Sequence: Synthetic oligonucleotide
  Target: ATXN1; (+) strand; PAM type: YTN; PAM sequence: CTG
cattccacctccagaaatgg

SEQ ID NO: 309168 - DNA, 20 bp, Artificial Sequence
  Description of Artificial Sequence: Synthetic oligonucleotide
  Target: ATXN1; (+) strand; PAM type: YTN; PAM sequence: TTC
cacctccagaaatggatgtt

SEQ ID NO: 309169 - DNA, 20 bp, Artificial Sequence
  Description of Artificial Sequence: Synthetic oligonucleotide
  Target: ATXN1; (+) strand; PAM type: YTN; PAM sequence: CTC
cagaaatggatgttgtttgg

SEQ ID NO: 309170 - DNA, 20 bp, Artificial Sequence
  Description of Artificial Sequence: Synthetic oligonucleotide
  Target: ATXN1; (+) strand; PAM type: YTN; PAM sequence: TTG
tttgggacatggtagcaaga

SEQ ID NO: 309171 - DNA, 20 bp, Artificial Sequence
  Description of Artificial Sequence: Synthetic oligonucleotide
  Target: ATXN1; (+) strand; PAM type: YTN; PAM sequence: TTT
gggacatggtagcaagaaca

SEQ ID NO: 309172 - DNA, 20 bp, Artificial Sequence
  Description of Artificial Sequence: Synthetic oligonucleotide
  Target: ATXN1; (+) strand; PAM type: YTN; PAM sequence: TTG
ggacatggtagcaagaacag

SEQ ID NO: 309173 - DNA, 20 bp, Artificial Sequence
  Description of Artificial Sequence: Synthetic oligonucleotide
  Target: ATXN1; (+) strand; PAM type: YTN; PAM sequence: TTC
aggtatgaaactaatataga

SEQ ID NO: 309174 - DNA, 20 bp, Artificial Sequence
  Description of Artificial Sequence: Synthetic oligonucleotide
  Target: ATXN1; (+) strand; PAM type: YTN; PAM sequence: CTA
atatagatggggtgataaat

SEQ ID NO: 309175 - DNA, 20 bp, Artificial Sequence
  Description of Artificial Sequence: Synthetic oligonucleotide
  Target: ATXN1; (+) strand; PAM type: YTN; PAM sequence: TTT
aggcaccgcttatgacttac

SEQ ID NO: 309176 - DNA, 20 bp, Artificial Sequence
  Description of Artificial Sequence: Synthetic oligonucleotide
  Target: ATXN1; (+) strand; PAM type: YTN; PAM sequence: TTA
ggcaccgcttatgacttact

SEQ ID NO: 309177 - DNA, 20 bp, Artificial Sequence
  Description of Artificial Sequence: Synthetic oligonucleotide
  Target: ATXN1; (+) strand; PAM type: YTN; PAM sequence: CTT
atgacttactctataaataa

SEQ ID NO: 309178 - DNA, 20 bp, Artificial Sequence
  Description of Artificial Sequence: Synthetic oligonucleotide
  Target: ATXN1; (+) strand; PAM type: YTN; PAM sequence: TTA
tgacttactctataaataat

SEQ ID NO: 309179 - DNA, 20 bp, Artificial Sequence
  Description of Artificial Sequence: Synthetic oligonucleotide
  Target: ATXN1; (+) strand; PAM type: YTN; PAM sequence: CTT
actctataaataatgacata

SEQ ID NO: 309180 - DNA, 20 bp, Artificial Sequence
  Description of Artificial Sequence: Synthetic oligonucleotide
  Target: ATXN1; (+) strand; PAM type: YTN; PAM sequence: TTA
ctctataaataatgacataa

SEQ ID NO: 309181 - DNA, 20 bp, Artificial Sequence
  Description of Artificial Sequence: Synthetic oligonucleotide
  Target: ATXN1; (+) strand; PAM type: YTN; PAM sequence: CTC
tataaataatgacataataa

SEQ ID NO: 309182 - DNA, 20 bp, Artificial Sequence
  Description of Artificial Sequence: Synthetic oligonucleotide
  Target: ATXN1; (+) strand; PAM type: YTN; PAM sequence: CTA
taaataatgacataataata

SEQ ID NO: 309183 - DNA, 20 bp, Artificial Sequence
  Description of Artificial Sequence: Synthetic oligonucleotide
  Target: ATXN1; (+) strand; PAM type: YTN; PAM sequence: CTA
aaatataaattctaattaaa

SEQ ID NO: 309184 - DNA, 20 bp, Artificial Sequence
  Description of Artificial Sequence: Synthetic oligonucleotide
  Target: ATXN1; (+) strand; PAM type: YTN; PAM sequence: TTC
taattaaatacaaaatctaa

SEQ ID NO: 309185 - DNA, 20 bp, Artificial Sequence
  Description of Artificial Sequence: Synthetic oligonucleotide
  Target: ATXN1; (+) strand; PAM type: YTN; PAM sequence: CTA
attaaatacaaaatctaaca

SEQ ID NO: 309186 - DNA, 20 bp, Artificial Sequence
  Description of Artificial Sequence: Synthetic oligonucleotide
  Target: ATXN1; (+) strand; PAM type: YTN; PAM sequence: TTA
aatacaaaatctaacaaagt

SEQ ID NO: 309187 - DNA, 20 bp, Artificial Sequence
  Description of Artificial Sequence: Synthetic oligonucleotide
  Target: ATXN1; (+) strand; PAM type: YTN; PAM sequence: CTA
acaaagtcaaacaacagcaa

SEQ ID NO: 309188 - DNA, 20 bp, Artificial Sequence
  Description of Artificial Sequence: Synthetic oligonucleotide
  Target: ATXN1; (+) strand; PAM type: YTN; PAM sequence: TTT
gacagaagcaaaggtcttgg

SEQ ID NO: 309189 - DNA, 20 bp, Artificial Sequence
  Description of Artificial Sequence: Synthetic oligonucleotide
  Target: ATXN1; (+) strand; PAM type: YTN; PAM sequence: TTG
acagaagcaaaggtcttggg

SEQ ID NO: 309190 - DNA, 20 bp, Artificial Sequence
  Description of Artificial Sequence: Synthetic oligonucleotide
  Target: ATXN1; (+) strand; PAM type: YTN; PAM sequence: CTT
gggggagccgggagcaagaa

SEQ ID NO: 309191 - DNA, 20 bp, Artificial Sequence
  Description of Artificial Sequence: Synthetic oligonucleotide
  Target: ATXN1; (+) strand; PAM type: YTN; PAM sequence: TTG
ggggagccgggagcaagaat

SEQ ID NO: 309192 - DNA, 20 bp, Artificial Sequence
  Description of Artificial Sequence: Synthetic oligonucleotide
  Target: ATXN1; (+) strand; PAM type: YTN; PAM sequence: TTA
caataaaatctattcatgga

SEQ ID NO: 309193 - DNA, 20 bp, Artificial Sequence
  Description of Artificial Sequence: Synthetic oligonucleotide
  Target: ATXN1; (+) strand; PAM type: YTN; PAM sequence: CTA
ttcatggaactgtacaatgt

SEQ ID NO: 309194 - DNA, 20 bp, Artificial Sequence
  Description of Artificial Sequence: Synthetic oligonucleotide
  Target: ATXN1; (+) strand; PAM type: YTN; PAM sequence: TTC
atggaactgtacaatgtcag

SEQ ID NO: 309195 - DNA, 20 bp, Artificial Sequence
  Description of Artificial Sequence: Synthetic oligonucleotide
  Target: ATXN1; (+) strand; PAM type: YTN; PAM sequence: CTG
tacaatgtcagagatagaag

SEQ ID NO: 309196 - DNA, 20 bp, Artificial Sequence
  Description of Artificial Sequence: Synthetic oligonucleotide
  Target: ATXN1; (+) strand; PAM type: YTN; PAM sequence: TTT
ctttcaacctccttgtgttt

SEQ ID NO: 309197 - DNA, 20 bp, Artificial Sequence
  Description of Artificial Sequence: Synthetic oligonucleotide
  Target: ATXN1; (+) strand; PAM type: YTN; PAM sequence: TTC
tttcaacctccttgtgtttt

SEQ ID NO: 309198 - DNA, 20 bp, Artificial Sequence
  Description of Artificial Sequence: Synthetic oligonucleotide
  Target: ATXN1; (+) strand; PAM type: YTN; PAM sequence: CTT
tcaacctccttgtgttttgg

SEQ ID NO: 309199 - DNA, 20 bp, Artificial Sequence
  Description of Artificial Sequence: Synthetic oligonucleotide
  Target: ATXN1; (+) strand; PAM type: YTN; PAM sequence: TTT
caacctccttgtgttttgga

SEQ ID NO: 309200 - DNA, 20 bp, Artificial Sequence
  Description of Artificial Sequence: Synthetic oligonucleotide
  Target: ATXN1; (+) strand; PAM type: YTN; PAM sequence: TTC
aacctccttgtgttttggag

SEQ ID NO: 309201 - DNA, 20 bp, Artificial Sequence
  Description of Artificial Sequence: Synthetic oligonucleotide
  Target: ATXN1; (+) strand; PAM type: YTN; PAM sequence: CTC
cttgtgttttggagacagga

SEQ ID NO: 309202 - DNA, 20 bp, Artificial Sequence
  Description of Artificial Sequence: Synthetic oligonucleotide
  Target: ATXN1; (+) strand; PAM type: YTN; PAM sequence: CTT
gtgttttggagacaggaaaa

SEQ ID NO: 309203 - DNA, 20 bp, Artificial Sequence
  Description of Artificial Sequence: Synthetic oligonucleotide
  Target: ATXN1; (+) strand; PAM type: YTN; PAM sequence: TTG
tgttttggagacaggaaaac

SEQ ID NO: 309204 - DNA, 20 bp, Artificial Sequence
  Description of Artificial Sequence: Synthetic oligonucleotide
  Target: ATXN1; (+) strand; PAM type: YTN; PAM sequence: TTT
tggagacaggaaaactgaga

SEQ ID NO: 309205 - DNA, 20 bp, Artificial Sequence
  Description of Artificial Sequence: Synthetic oligonucleotide
  Target: ATXN1; (+) strand; PAM type: YTN; PAM sequence: TTT
ggagacaggaaaactgagac

SEQ ID NO: 309206 - DNA, 20 bp, Artificial Sequence
  Description of Artificial Sequence: Synthetic oligonucleotide
  Target: ATXN1; (+) strand; PAM type: YTN; PAM sequence: TTG
gagacaggaaaactgagacc

SEQ ID NO: 309207 - DNA, 20 bp, Artificial Sequence
  Description of Artificial Sequence: Synthetic oligonucleotide
  Target: ATXN1; (+) strand; PAM type: YTN; PAM sequence: CTG
agacccagcaaggtacagtg

SEQ ID NO: 309208 - DNA, 20 bp, Artificial Sequence
  Description of Artificial Sequence: Synthetic oligonucleotide
  Target: ATXN1; (+) strand; PAM type: YTN; PAM sequence: CTG
ttgcagggcaggcaacagaa

SEQ ID NO: 309209 - DNA, 20 bp, Artificial Sequence
  Description of Artificial Sequence: Synthetic oligonucleotide
  Target: ATXN1; (+) strand; PAM type: YTN; PAM sequence: TTG
cagggcaggcaacagaaact

SEQ ID NO: 309210 - DNA, 20 bp, Artificial Sequence
  Description of Artificial Sequence: Synthetic oligonucleotide
  Target: ATXN1; (+) strand; PAM type: YTN; PAM sequence: CTG
agcctccaaactaccagtcc

SEQ ID NO: 309211 - DNA, 20 bp, Artificial Sequence
  Description of Artificial Sequence: Synthetic oligonucleotide
  Target: ATXN1; (+) strand; PAM type: YTN; PAM sequence: CTC
caaactaccagtccaacagc

SEQ ID NO: 309212 - DNA, 20 bp, Artificial Sequence
  Description of Artificial Sequence: Synthetic oligonucleotide
  Target: ATXN1; (+) strand; PAM type: YTN; PAM sequence: CTA
ccagtccaacagcacaccat

SEQ ID NO: 309213 - DNA, 20 bp, Artificial Sequence
  Description of Artificial Sequence: Synthetic oligonucleotide
  Target: ATXN1; (+) strand; PAM type: YTN; PAM sequence: CTC
actctgtagggtcctggaag

SEQ ID NO: 309214 - DNA, 20 bp, Artificial Sequence
  Description of Artificial Sequence: Synthetic oligonucleotide
  Target: ATXN1; (+) strand; PAM type: YTN; PAM sequence: CTC
tgtagggtcctggaagacta

SEQ ID NO: 309215 - DNA, 20 bp, Artificial Sequence
  Description of Artificial Sequence: Synthetic oligonucleotide
  Target: ATXN1; (+) strand; PAM type: YTN; PAM sequence: CTG
tagggtcctggaagactact

SEQ ID NO: 309216 - DNA, 20 bp, Artificial Sequence
  Description of Artificial Sequence: Synthetic oligonucleotide
  Target: ATXN1; (+) strand; PAM type: YTN; PAM sequence: CTG
gaagactactccatttgaaa

SEQ ID NO: 309217 - DNA, 20 bp, Artificial Sequence
  Description of Artificial Sequence: Synthetic oligonucleotide
  Target: ATXN1; (+) strand; PAM type: YTN; PAM sequence: CTA
ctccatttgaaaccatattt

SEQ ID NO: 309218 - DNA, 20 bp, Artificial Sequence
  Description of Artificial Sequence: Synthetic oligonucleotide
  Target: ATXN1; (+) strand; PAM type: YTN; PAM sequence: CTC
catttgaaaccatattttca

SEQ ID NO: 309219 - DNA, 20 bp, Artificial Sequence
  Description of Artificial Sequence: Synthetic oligonucleotide
  Target: ATXN1; (+) strand; PAM type: YTN; PAM sequence: TTT
gaaaccatattttcaaaaga

SEQ ID NO: 309220 - DNA, 20 bp, Artificial Sequence
  Description of Artificial Sequence: Synthetic oligonucleotide
  Target: ATXN1; (+) strand; PAM type: YTN; PAM sequence: TTG
aaaccatattttcaaaagat

SEQ ID NO: 309221 - DNA, 20 bp, Artificial Sequence
  Description of Artificial Sequence: Synthetic oligonucleotide
  Target: ATXN1; (+) strand; PAM type: YTN; PAM sequence: TTT
tcaaaagatcattaaacatt

SEQ ID NO: 309222 - DNA, 20 bp, Artificial Sequence
  Description of Artificial Sequence: Synthetic oligonucleotide
  Target: ATXN1; (+) strand; PAM type: YTN; PAM sequence: TTT
caaaagatcattaaacattc

SEQ ID NO: 309223 - DNA, 20 bp, Artificial Sequence
  Description of Artificial Sequence: Synthetic oligonucleotide
  Target: ATXN1; (+) strand; PAM type: YTN; PAM sequence: TTC
aaaagatcattaaacattct

SEQ ID NO: 309224 - DNA, 20 bp, Artificial Sequence
  Description of Artificial Sequence: Synthetic oligonucleotide
  Target: ATXN1; (+) strand; PAM type: YTN; PAM sequence: TTA
aacattctatacatattaaa

SEQ ID NO: 309225 - DNA, 20 bp, Artificial Sequence
  Description of Artificial Sequence: Synthetic oligonucleotide
  Target: ATXN1; (+) strand; PAM type: YTN; PAM sequence: TTC
tatacatattaaattccttt

SEQ ID NO: 309226 - DNA, 20 bp, Artificial Sequence
  Description of Artificial Sequence: Synthetic oligonucleotide
  Target: ATXN1; (+) strand; PAM type: YTN; PAM sequence: CTA
tacatattaaattccttttt

SEQ ID NO: 309227 - DNA, 20 bp, Artificial Sequence
  Description of Artificial Sequence: Synthetic oligonucleotide
  Target: ATXN1; (+) strand; PAM type: YTN; PAM sequence: TTA
aattcctttttaataatttt

SEQ ID NO: 309228 - DNA, 20 bp, Artificial Sequence
  Description of Artificial Sequence: Synthetic oligonucleotide
  Target: ATXN1; (+) strand; PAM type: YTN; PAM sequence: TTC
ctttttaataattttctaat

SEQ ID NO: 309229 - DNA, 20 bp, Artificial Sequence
  Description of Artificial Sequence: Synthetic oligonucleotide
  Target: ATXN1; (+) strand; PAM type: YTN; PAM sequence: CTT
tttaataattttctaatgca

SEQ ID NO: 309230 - DNA, 20 bp, Artificial Sequence
  Description of Artificial Sequence: Synthetic oligonucleotide
  Target: ATXN1; (+) strand; PAM type: YTN; PAM sequence: TTT
ttaataattttctaatgcac

SEQ ID NO: 309231 - DNA, 20 bp, Artificial Sequence
  Description of Artificial Sequence: Synthetic oligonucleotide
  Target: ATXN1; (+) strand; PAM type: YTN; PAM sequence: TTT
taataattttctaatgcaca

SEQ ID NO: 309232 - DNA, 20 bp, Artificial Sequence
  Description of Artificial Sequence: Synthetic oligonucleotide
  Target: ATXN1; (+) strand; PAM type: YTN; PAM sequence: TTT
aataattttctaatgcacag

SEQ ID NO: 309233 - DNA, 20 bp, Artificial Sequence
  Description of Artificial Sequence: Synthetic oligonucleotide
  Target: ATXN1; (+) strand; PAM type: YTN; PAM sequence: TTA
ataattttctaatgcacagg

SEQ ID NO: 309234 - DNA, 20 bp, Artificial Sequence
  Description of Artificial Sequence: Synthetic oligonucleotide
  Target: ATXN1; (+) strand; PAM type: YTN; PAM sequence: TTT
tctaatgcacaggggcacat

SEQ ID NO: 309235 - DNA, 20 bp, Artificial Sequence
  Description of Artificial Sequence: Synthetic oligonucleotide
  Target: ATXN1; (+) strand; PAM type: YTN; PAM sequence: TTT
ctaatgcacaggggcacatt

SEQ ID NO: 309236 - DNA, 20 bp, Artificial Sequence
  Description of Artificial Sequence: Synthetic oligonucleotide
  Target: ATXN1; (+) strand; PAM type: YTN; PAM sequence: TTC
taatgcacaggggcacattt

SEQ ID NO: 309237 - DNA, 20 bp, Artificial Sequence
  Description of Artificial Sequence: Synthetic oligonucleotide
  Target: ATXN1; (+) strand; PAM type: YTN; PAM sequence: CTA
atgcacaggggcacatttta

SEQ ID NO: 309238 - DNA, 20 bp, Artificial Sequence
  Description of Artificial Sequence: Synthetic oligonucleotide
  Target: ATXN1; (+) strand; PAM type: YTN; PAM sequence: TTT
taaaaagaagcctggttttg

SEQ ID NO: 309239 - DNA, 20 bp, Artificial Sequence
  Description of Artificial Sequence: Synthetic oligonucleotide
  Target: ATXN1; (+) strand; PAM type: YTN; PAM sequence: TTT
aaaaagaagcctggttttga

SEQ ID NO: 309240 - DNA, 20 bp, Artificial Sequence
  Description of Artificial Sequence: Synthetic oligonucleotide
  Target: ATXN1; (+) strand; PAM type: YTN; PAM sequence: TTA
aaaagaagcctggttttgat

SEQ ID NO: 309241 - DNA, 20 bp, Artificial Sequence
  Description of Artificial Sequence: Synthetic oligonucleotide
  Target: ATXN1; (+) strand; PAM type: YTN; PAM sequence: CTG
gttttgatttcttttggaaa

SEQ ID NO: 309242 - DNA, 20 bp, Artificial Sequence
  Description of Artificial Sequence: Synthetic oligonucleotide
  Target: ATXN1; (+) strand; PAM type: YTN; PAM sequence: TTT
tgatttcttttggaaaactg

SEQ ID NO: 309243 - DNA, 20 bp, Artificial Sequence
  Description of Artificial Sequence: Synthetic oligonucleotide
  Target: ATXN1; (+) strand; PAM type: YTN; PAM sequence: TTT
gatttcttttggaaaactgc

SEQ ID NO: 309244 - DNA, 20 bp, Artificial Sequence
  Description of Artificial Sequence: Synthetic oligonucleotide
  Target: ATXN1; (+) strand; PAM type: YTN; PAM sequence: TTG
atttcttttggaaaactgca

SEQ ID NO: 309245 - DNA, 20 bp, Artificial Sequence
  Description of Artificial Sequence: Synthetic oligonucleotide
  Target: ATXN1; (+) strand; PAM type: YTN; PAM sequence: TTT
cttttggaaaactgcacgct

SEQ ID NO: 309246 - DNA, 20 bp, Artificial Sequence
  Description of Artificial Sequence: Synthetic oligonucleotide
  Target: ATXN1; (+) strand; PAM type: YTN; PAM sequence: TTC
ttttggaaaactgcacgctg

SEQ ID NO: 309247 - DNA, 20 bp, Artificial Sequence
  Description of Artificial Sequence: Synthetic oligonucleotide
  Target: ATXN1; (+) strand; PAM type: YTN; PAM sequence: CTT
ttggaaaactgcacgctgct

SEQ ID NO: 309248 - DNA, 20 bp, Artificial Sequence
  Description of Artificial Sequence: Synthetic oligonucleotide
  Target: ATXN1; (+) strand; PAM type: YTN; PAM sequence: TTT
tggaaaactgcacgctgctc

SEQ ID NO: 309249 - DNA, 20 bp, Artificial Sequence
  Description of Artificial Sequence: Synthetic oligonucleotide
  Target: ATXN1; (+) strand; PAM type: YTN; PAM sequence: TTT
ggaaaactgcacgctgctcg

SEQ ID NO: 309250 - DNA, 20 bp, Artificial Sequence
  Description of Artificial Sequence: Synthetic oligonucleotide
  Target: ATXN1; (+) strand; PAM type: YTN; PAM sequence: TTG
gaaaactgcacgctgctcgg

SEQ ID NO: 309251 - DNA, 20 bp, Artificial Sequence
  Description of Artificial Sequence: Synthetic oligonucleotide
  Target: ATXN1; (+) strand; PAM type: YTN; PAM sequence: CTG
cacgctgctcggtgtttaat

SEQ ID NO: 309252 - DNA, 20 bp, Artificial Sequence
  Description of Artificial Sequence: Synthetic oligonucleotide
  Target: ATXN1; (+) strand; PAM type: YTN; PAM sequence: CTG
ctcggtgtttaatctggtat

SEQ ID NO: 309253 - DNA, 20 bp, Artificial Sequence
  Description of Artificial Sequence: Synthetic oligonucleotide
  Target: ATXN1; (+) strand; PAM type: YTN; PAM sequence: CTC
ggtgtttaatctggtattga

SEQ ID NO: 309254 - DNA, 20 bp, Artificial Sequence
  Description of Artificial Sequence: Synthetic oligonucleotide
  Target: ATXN1; (+) strand; PAM type: YTN; PAM sequence: TTT
aatctggtattgagtgaaat

SEQ ID NO: 309255 - DNA, 20 bp, Artificial Sequence
  Description of Artificial Sequence: Synthetic oligonucleotide
  Target: ATXN1; (+) strand; PAM type: YTN; PAM sequence: TTA
atctggtattgagtgaaata

SEQ ID NO: 309256 - DNA, 20 bp, Artificial Sequence
  Description of Artificial Sequence: Synthetic oligonucleotide
  Target: ATXN1; (+) strand; PAM type: YTN; PAM sequence: CTG
gtattgagtgaaatattaac

SEQ ID NO: 309257 - DNA, 20 bp, Artificial Sequence
  Description of Artificial Sequence: Synthetic oligonucleotide
  Target: ATXN1; (+) strand; PAM type: YTN; PAM sequence: TTG
agtgaaatattaacaggcca

SEQ ID NO: 309258 - DNA, 20 bp, Artificial Sequence
  Description of Artificial Sequence: Synthetic oligonucleotide
  Target: ATXN1; (+) strand; PAM type: YTN; PAM sequence: TTA
acaggccatataatggtttc

SEQ ID NO: 309259 - DNA, 20 bp, Artificial Sequence
  Description of Artificial Sequence: Synthetic oligonucleotide
  Target: ATXN1; (+) strand; PAM type: YTN; PAM sequence: TTT
cactgttccttcagtaaagc

SEQ ID NO: 309260 - DNA, 20 bp, Artificial Sequence
  Description of Artificial Sequence: Synthetic oligonucleotide
  Target: ATXN1; (+) strand; PAM type: YTN; PAM sequence: TTC
actgttccttcagtaaagct

SEQ ID NO: 309261 - DNA, 20 bp, Artificial Sequence
  Description of Artificial Sequence: Synthetic oligonucleotide
  Target: ATXN1; (+) strand; PAM type: YTN; PAM sequence: CTG
ttccttcagtaaagctaaac

SEQ ID NO: 309262 - DNA, 20 bp, Artificial Sequence
  Description of Artificial Sequence: Synthetic oligonucleotide
  Target: ATXN1; (+) strand; PAM type: YTN; PAM sequence: TTC
cttcagtaaagctaaacaga

SEQ ID NO: 309263 - DNA, 20 bp, Artificial Sequence
  Description of Artificial Sequence: Synthetic oligonucleotide
  Target: ATXN1; (+) strand; PAM type: YTN; PAM sequence: CTT
cagtaaagctaaacagaact

SEQ ID NO: 309264 - DNA, 20 bp, Artificial Sequence
  Description of Artificial Sequence: Synthetic oligonucleotide
  Target: ATXN1; (+) strand; PAM type: YTN; PAM sequence: TTC
agtaaagctaaacagaactc

SEQ ID NO: 309265 - DNA, 20 bp, Artificial Sequence
  Description of Artificial Sequence: Synthetic oligonucleotide
  Target: ATXN1; (+) strand; PAM type: YTN; PAM sequence: CTA
aacagaactcgaaaaacata

SEQ ID NO: 309266 - DNA, 20 bp, Artificial Sequence
  Description of Artificial Sequence: Synthetic oligonucleotide
  Target: ATXN1; (+) strand; PAM type: YTN; PAM sequence: CTC
gaaaaacatatcccccaggc

SEQ ID NO: 309267 - DNA, 20 bp, Artificial Sequence
  Description of Artificial Sequence: Synthetic oligonucleotide
  Target: ATXN1; (+) strand; PAM type: YTN; PAM sequence: CTA
cagtggagtttctggagcac

SEQ ID NO: 309268 - DNA, 20 bp, Artificial Sequence
  Description of Artificial Sequence: Synthetic oligonucleotide
  Target: ATXN1; (+) strand; PAM type: YTN; PAM sequence: TTT
ctggagcacacattaaactc

SEQ ID NO: 309269 - DNA, 20 bp, Artificial Sequence
  Description of Artificial Sequence: Synthetic oligonucleotide
  Target: ATXN1; (+) strand; PAM type: YTN; PAM sequence: TTC
tggagcacacattaaactcc

SEQ ID NO: 309270 - DNA, 20 bp, Artificial Sequence
  Description of Artificial Sequence: Synthetic oligonucleotide
  Target: ATXN1; (+) strand; PAM type: YTN; PAM sequence: CTG
gagcacacattaaactccac

SEQ ID NO: 309271 - DNA, 20 bp, Artificial Sequence
  Description of Artificial Sequence: Synthetic oligonucleotide
  Target: ATXN1; (+) strand; PAM type: YTN; PAM sequence: TTA
aactccacgctctgctcaac

SEQ ID NO: 309272 - DNA, 20 bp, Artificial Sequence
  Description of Artificial Sequence: Synthetic oligonucleotide
  Target: ATXN1; (+) strand; PAM type: YTN; PAM sequence: CTC
cacgctctgctcaacaagcc

SEQ ID NO: 309273 - DNA, 20 bp, Artificial Sequence
  Description of Artificial Sequence: Synthetic oligonucleotide
  Target: ATXN1; (+) strand; PAM type: YTN; PAM sequence: CTC
tgctcaacaagcccatcgct

SEQ ID NO: 309274 - DNA, 20 bp, Artificial Sequence
  Description of Artificial Sequence: Synthetic oligonucleotide
  Target: ATXN1; (+) strand; PAM type: YTN; PAM sequence: CTG
ctcaacaagcccatcgctgt

SEQ ID NO: 309275 - DNA, 20 bp, Artificial Sequence
  Description of Artificial Sequence: Synthetic oligonucleotide
  Target: ATXN1; (+) strand; PAM type: YTN; PAM sequence: CTC
aacaagcccatcgctgttaa

SEQ ID NO: 309276 - DNA, 20 bp, Artificial Sequence
  Description of Artificial Sequence: Synthetic oligonucleotide
  Target: ATXN1; (+) strand; PAM type: YTN; PAM sequence: CTG
ttaagtaactcatcagaaaa

SEQ ID NO: 309277 - DNA, 20 bp, Artificial Sequence
  Description of Artificial Sequence: Synthetic oligonucleotide
  Target: ATXN1; (+) strand; PAM type: YTN; PAM sequence: TTA
agtaactcatcagaaaataa

SEQ ID NO: 309278 - DNA, 20 bp, Artificial Sequence
  Description of Artificial Sequence: Synthetic oligonucleotide
  Target: ATXN1; (+) strand; PAM type: YTN; PAM sequence: CTC
atcagaaaataaagagggaa

SEQ ID NO: 309279 - DNA, 20 bp, Artificial Sequence
  Description of Artificial Sequence: Synthetic oligonucleotide
  Target: ATXN1; (+) strand; PAM type: YTN; PAM sequence: TTA
ccaaaggggaattgccaagc

SEQ ID NO: 309280 - DNA, 20 bp, Artificial Sequence
  Description of Artificial Sequence: Synthetic oligonucleotide
  Target: ATXN1; (+) strand; PAM type: YTN; PAM sequence: TTG
ccaagcaattagttctctga

SEQ ID NO: 309281 - DNA, 20 bp, Artificial Sequence
  Description of Artificial Sequence: Synthetic oligonucleotide
  Target: ATXN1; (+) strand; PAM type: YTN; PAM sequence: TTA
gttctctgaagcagacgaca

SEQ ID NO: 309282 - DNA, 20 bp, Artificial Sequence
  Description of Artificial Sequence: Synthetic oligonucleotide
  Target: ATXN1; (+) strand; PAM type: YTN; PAM sequence: TTC
tctgaagcagacgacataca

SEQ ID NO: 309283 - DNA, 20 bp, Artificial Sequence
  Description of Artificial Sequence: Synthetic oligonucleotide
  Target: ATXN1; (+) strand; PAM type: YTN; PAM sequence: CTC
tgaagcagacgacatacaac

SEQ ID NO: 309284 - DNA, 20 bp, Artificial Sequence
  Description of Artificial Sequence: Synthetic oligonucleotide
  Target: ATXN1; (+) strand; PAM type: YTN; PAM sequence: CTG
aagcagacgacatacaactg

SEQ ID NO: 309285 - DNA, 20 bp, Artificial Sequence
  Description of Artificial Sequence: Synthetic oligonucleotide
  Target: ATXN1; (+) strand; PAM type: YTN; PAM sequence: CTG
ttacagggaggagcttcccg

SEQ ID NO: 309286 - DNA, 20 bp, Artificial Sequence
  Description of Artificial Sequence: Synthetic oligonucleotide
  Target: ATXN1; (+) strand; PAM type: YTN; PAM sequence: TTA
cagggaggagcttcccggtt

SEQ ID NO: 309287 - DNA, 20 bp, Artificial Sequence
  Description of Artificial Sequence: Synthetic oligonucleotide
  Target: ATXN1; (+) strand; PAM type: YTN; PAM sequence: CTT
cccggttagtcatatgtcag

SEQ ID NO: 309288 - DNA, 20 bp, Artificial Sequence
  Description of Artificial Sequence: Synthetic oligonucleotide
  Target: ATXN1; (+) strand; PAM type: YTN; PAM sequence: TTC
ccggttagtcatatgtcaga

SEQ ID NO: 309289 - DNA, 20 bp, Artificial Sequence
  Description of Artificial Sequence: Synthetic oligonucleotide
  Target: ATXN1; (+) strand; PAM type: YTN; PAM sequence: TTA
gtcatatgtcagagtcagag

SEQ ID NO: 309290 - DNA, 20 bp, Artificial Sequence
  Description of Artificial Sequence: Synthetic oligonucleotide
  Target: ATXN1; (+) strand; PAM type: YTN; PAM sequence: CTA
ctaatctgtaaataaaaatg

SEQ ID NO: 309291 - DNA, 20 bp, Artificial Sequence
  Description of Artificial Sequence: Synthetic oligonucleotide
  Target: ATXN1; (+) strand; PAM type: YTN; PAM sequence: CTA
atctgtaaataaaaatgcat

SEQ ID NO: 309292 - DNA, 20 bp, Artificial Sequence
  Description of Artificial Sequence: Synthetic oligonucleotide
  Target: ATXN1; (+) strand; PAM type: YTN; PAM sequence: CTG
taaataaaaatgcatcacat

SEQ ID NO: 309293 - DNA, 20 bp, Artificial Sequence
  Description of Artificial Sequence: Synthetic oligonucleotide
  Target: ATXN1; (+) strand; PAM type: YTN; PAM sequence: TTA
cagctgtgatgtaggctgaa

SEQ ID NO: 309294 - DNA, 20 bp, Artificial Sequence
  Description of Artificial Sequence: Synthetic oligonucleotide
  Target: ATXN1; (+) strand; PAM type: YTN; PAM sequence: CTG
tgatgtaggctgaagctgcc

SEQ ID NO: 309295 - DNA, 20 bp, Artificial Sequence
  Description of Artificial Sequence: Synthetic oligonucleotide
  Target: ATXN1; (+) strand; PAM type: YTN; PAM sequence: CTG
aagctgccaggctagggcac

SEQ ID NO: 309296 - DNA, 20 bp, Artificial Sequence
  Description of Artificial Sequence: Synthetic oligonucleotide
  Target: ATXN1; (+) strand; PAM type: YTN; PAM sequence: CTG
ccaggctagggcacgaatag

SEQ ID NO: 309297 - DNA, 20 bp, Artificial Sequence
  Description of Artificial Sequence: Synthetic oligonucleotide
  Target: ATXN1; (+) strand; PAM type: YTN; PAM sequence: CTA
gggcacgaatagtaaatctt

SEQ ID NO: 309298 - DNA, 20 bp, Artificial Sequence
  Description of Artificial Sequence: Synthetic oligonucleotide
  Target: ATXN1; (+) strand; PAM type: YTN; PAM sequence: CTT
gcatcctcttctcgatttcc

SEQ ID NO: 309299 - DNA, 20 bp, Artificial Sequence
  Description of Artificial Sequence: Synthetic oligonucleotide
  Target: ATXN1; (+) strand; PAM type: YTN; PAM sequence: TTG
catcctcttctcgatttccg

SEQ ID NO: 309300 - DNA, 20 bp, Artificial Sequence
  Description of Artificial Sequence: Synthetic oligonucleotide
  Target: ATXN1; (+) strand; PAM type: YTN; PAM sequence: CTC
ttctcgatttccgtgggtct

SEQ ID NO: 309301 - DNA, 20 bp, Artificial Sequence
  Description of Artificial Sequence: Synthetic oligonucleotide
  Target: ATXN1; (+) strand; PAM type: YTN; PAM sequence: CTT
ctcgatttccgtgggtctgt

SEQ ID NO: 309302 - DNA, 20 bp, Artificial Sequence
  Description of Artificial Sequence: Synthetic oligonucleotide
  Target: ATXN1; (+) strand; PAM type: YTN; PAM sequence: TTC
tcgatttccgtgggtctgta

SEQ ID NO: 309303 - DNA, 20 bp, Artificial Sequence
  Description of Artificial Sequence: Synthetic oligonucleotide
  Target: ATXN1; (+) strand; PAM type: YTN; PAM sequence: CTC
gatttccgtgggtctgtaaa

SEQ ID NO: 309304 - DNA, 20 bp, Artificial Sequence
  Description of Artificial Sequence: Synthetic oligonucleotide
  Target: ATXN1; (+) strand; PAM type: YTN; PAM sequence: TTT
ccgtgggtctgtaaaagcaa

SEQ ID NO: 309305 - DNA, 20 bp, Artificial Sequence
  Description of Artificial Sequence: Synthetic oligonucleotide
  Target: ATXN1; (+) strand; PAM type: YTN; PAM sequence: TTC
cgtgggtctgtaaaagcaag

SEQ ID NO: 309306 - DNA, 20 bp, Artificial Sequence
  Description of Artificial Sequence: Synthetic oligonucleotide
  Target: ATXN1; (+) strand; PAM type: YTN; PAM sequence: CTG
taaaagcaagagatgttgcc

SEQ ID NO: 309307 - DNA, 20 bp, Artificial Sequence
  Description of Artificial Sequence: Synthetic oligonucleotide
  Target: ATXN1; (+) strand; PAM type: YTN; PAM sequence: TTG
ccttgaagaccaaaaaaaaa

SEQ ID NO: 309308 - DNA, 20 bp, Artificial Sequence
  Description of Artificial Sequence: Synthetic oligonucleotide
  Target: ATXN1; (+) strand; PAM type: YTN; PAM sequence: CTT
gaagaccaaaaaaaaaaaaa

SEQ ID NO: 309309 - DNA, 20 bp, Artificial Sequence
  Description of Artificial Sequence: Synthetic oligonucleotide
  Target: ATXN1; (+) strand; PAM type: YTN; PAM sequence: TTG
aagaccaaaaaaaaaaaaaa

SEQ ID NO: 309310 - DNA, 20 bp, Artificial Sequence
  Description of Artificial Sequence: Synthetic oligonucleotide
  Target: ATXN1; (+) strand; PAM type: YTN; PAM sequence: CTC
agtaatttttcactcagtgt

SEQ ID NO: 309311 - DNA, 20 bp, Artificial Sequence
  Description of Artificial Sequence: Synthetic oligonucleotide
  Target: ATXN1; (+) strand; PAM type: YTN; PAM sequence: TTT
ttcactcagtgtaagaaaga

SEQ ID NO: 309312 - DNA, 20 bp, Artificial Sequence
  Description of Artificial Sequence: Synthetic oligonucleotide
  Target: ATXN1; (+) strand; PAM type: YTN; PAM sequence: TTT
tcactcagtgtaagaaagac

SEQ ID NO: 309313 - DNA, 20 bp, Artificial Sequence
  Description of Artificial Sequence: Synthetic oligonucleotide
  Target: ATXN1; (+) strand; PAM type: YTN; PAM sequence: TTT
cactcagtgtaagaaagaca

SEQ ID NO: 309314 - DNA, 20 bp, Artificial Sequence
  Description of Artificial Sequence: Synthetic oligonucleotide
  Target: ATXN1; (+) strand; PAM type: YTN; PAM sequence: TTC
actcagtgtaagaaagacaa

SEQ ID NO: 309315 - DNA, 20 bp, Artificial Sequence
  Description of Artificial Sequence: Synthetic oligonucleotide
  Target: ATXN1; (+) strand; PAM type: YTN; PAM sequence: CTC
agtgtaagaaagacaatctg

SEQ ID NO: 309316 - DNA, 20 bp, Artificial Sequence
  Description of Artificial Sequence: Synthetic oligonucleotide
  Target: ATXN1; (+) strand; PAM type: YTN; PAM sequence: CTG
gccttccctaagccagctaa

SEQ ID NO: 309317 - DNA, 20 bp, Artificial Sequence
  Description of Artificial Sequence: Synthetic oligonucleotide
  Target: ATXN1; (+) strand; PAM type: YTN; PAM sequence: CTT
ccctaagccagctaagagaa

SEQ ID NO: 309318 - DNA, 20 bp, Artificial Sequence
  Description of Artificial Sequence: Synthetic oligonucleotide
  Target: ATXN1; (+) strand; PAM type: YTN; PAM sequence: TTC
cctaagccagctaagagaaa

SEQ ID NO: 309319 - DNA, 20 bp, Artificial Sequence
  Description of Artificial Sequence: Synthetic oligonucleotide
  Target: ATXN1; (+) strand; PAM type: YTN; PAM sequence: CTA
agccagctaagagaaagtga

SEQ ID NO: 309320 - DNA, 20 bp, Artificial Sequence
  Description of Artificial Sequence: Synthetic oligonucleotide
  Target: ATXN1; (+) strand; PAM type: YTN; PAM sequence: CTA
agagaaagtgatctttcttc

SEQ ID NO: 309321 - DNA, 20 bp, Artificial Sequence
  Description of Artificial Sequence: Synthetic oligonucleotide
  Target: ATXN1; (+) strand; PAM type: YTN; PAM sequence: CTT
tcttctctatcatcttgaca

SEQ ID NO: 309322 - DNA, 20 bp, Artificial Sequence
  Description of Artificial Sequence: Synthetic oligonucleotide
  Target: ATXN1; (+) strand; PAM type: YTN; PAM sequence: TTT
cttctctatcatcttgacat

SEQ ID NO: 309323 - DNA, 20 bp, Artificial Sequence
  Description of Artificial Sequence: Synthetic oligonucleotide
  Target: ATXN1; (+) strand; PAM type: YTN; PAM sequence: TTC
ttctctatcatcttgacatg

SEQ ID NO: 309324 - DNA, 20 bp, Artificial Sequence
  Description of Artificial Sequence: Synthetic oligonucleotide
  Target: ATXN1; (+) strand; PAM type: YTN; PAM sequence: CTT
ctctatcatcttgacatgaa

SEQ ID NO: 309325 - DNA, 20 bp, Artificial Sequence
  Description of Artificial Sequence: Synthetic oligonucleotide
  Target: ATXN1; (+) strand; PAM type: YTN; PAM sequence: TTC
tctatcatcttgacatgaat

SEQ ID NO: 309326 - DNA, 20 bp, Artificial Sequence
  Description of Artificial Sequence: Synthetic oligonucleotide
  Target: ATXN1; (+) strand; PAM type: YTN; PAM sequence: CTC
tatcatcttgacatgaatga

SEQ ID NO: 309327 - DNA, 20 bp, Artificial Sequence
  Description of Artificial Sequence: Synthetic oligonucleotide
  Target: ATXN1; (+) strand; PAM type: YTN; PAM sequence: CTA
tcatcttgacatgaatgagc

SEQ ID NO: 309328 - DNA, 20 bp, Artificial Sequence
  Description of Artificial Sequence: Synthetic oligonucleotide
  Target: ATXN1; (+) strand; PAM type: YTN; PAM sequence: CTT
gacatgaatgagctcagatt

SEQ ID NO: 309329 - DNA, 20 bp, Artificial Sequence
  Description of Artificial Sequence: Synthetic oligonucleotide
  Target: ATXN1; (+) strand; PAM type: YTN; PAM sequence: TTG
acatgaatgagctcagattc

SEQ ID NO: 309330 - DNA, 20 bp, Artificial Sequence
  Description of Artificial Sequence: Synthetic oligonucleotide
  Target: ATXN1; (+) strand; PAM type: YTN; PAM sequence: CTC
agattcattcactgttctag

SEQ ID NO: 309331 - DNA, 20 bp, Artificial Sequence
  Description of Artificial Sequence: Synthetic oligonucleotide
  Target: ATXN1; (+) strand; PAM type: YTN; PAM sequence: TTC
attcactgttctagtgaagg

SEQ ID NO: 309332 - DNA, 20 bp, Artificial Sequence
  Description of Artificial Sequence: Synthetic oligonucleotide
  Target: ATXN1; (+) strand; PAM type: YTN; PAM sequence: TTC
actgttctagtgaaggagag

SEQ ID NO: 309333 - DNA, 20 bp, Artificial Sequence
  Description of Artificial Sequence: Synthetic oligonucleotide
  Target: ATXN1; (+) strand; PAM type: YTN; PAM sequence: CTG
ttctagtgaaggagagaaaa

SEQ ID NO: 309334 - DNA, 20 bp, Artificial Sequence
  Description of Artificial Sequence: Synthetic oligonucleotide
  Target: ATXN1; (+) strand; PAM type: YTN; PAM sequence: TTC
tagtgaaggagagaaaatga

SEQ ID NO: 309335 - DNA, 20 bp, Artificial Sequence
  Description of Artificial Sequence: Synthetic oligonucleotide
  Target: ATXN1; (+) strand; PAM type: YTN; PAM sequence: CTA
gtgaaggagagaaaatgaga

SEQ ID NO: 309336 - DNA, 20 bp, Artificial Sequence
  Description of Artificial Sequence: Synthetic oligonucleotide
  Target: ATXN1; (+) strand; PAM type: YTN; PAM sequence: CTG
ggcgaggcaggggcagaggg

SEQ ID NO: 309337 - DNA, 20 bp, Artificial Sequence
  Description of Artificial Sequence: Synthetic oligonucleotide
  Target: ATXN1; (+) strand; PAM type: YTN; PAM sequence: TTC
taagcttccttatggccacc

SEQ ID NO: 309338 - DNA, 20 bp, Artificial Sequence
  Description of Artificial Sequence: Synthetic oligonucleotide
  Target: ATXN1; (+) strand; PAM type: YTN; PAM sequence: CTA
agcttccttatggccaccct

SEQ ID NO: 309339 - DNA, 20 bp, Artificial Sequence
  Description of Artificial Sequence: Synthetic oligonucleotide
  Target: ATXN1; (+) strand; PAM type: YTN; PAM sequence: CTT
ccttatggccaccctgacta

SEQ ID NO: 309340 - DNA, 20 bp, Artificial Sequence
  Description of Artificial Sequence: Synthetic oligonucleotide
  Target: ATXN1; (+) strand; PAM type: YTN; PAM sequence: TTC
cttatggccaccctgactaa

SEQ ID NO: 309341 - DNA, 20 bp, Artificial Sequence
  Description of Artificial Sequence: Synthetic oligonucleotide
  Target: ATXN1; (+) strand; PAM type: YTN; PAM sequence: CTT
atggccaccctgactaaagc

SEQ ID NO: 309342 - DNA, 20 bp, Artificial Sequence
  Description of Artificial Sequence: Synthetic oligonucleotide
  Target: ATXN1; (+) strand; PAM type: YTN; PAM sequence: TTA
tggccaccctgactaaagcg

SEQ ID NO: 309343 - DNA, 20 bp, Artificial Sequence
  Description of Artificial Sequence: Synthetic oligonucleotide
  Target: ATXN1; (+) strand; PAM type: YTN; PAM sequence: CTG
actaaagcgtgacctccttt

SEQ ID NO: 309344 - DNA, 20 bp, Artificial Sequence
  Description of Artificial Sequence: Synthetic oligonucleotide
  Target: ATXN1; (+) strand; PAM type: YTN; PAM sequence: CTA
aagcgtgacctccttttgct

SEQ ID NO: 309345 - DNA, 20 bp, Artificial Sequence
  Description of Artificial Sequence: Synthetic oligonucleotide
  Target: ATXN1; (+) strand; PAM type: YTN; PAM sequence: CTC
cttttgctgcacgttttatt

SEQ ID NO: 309346 - DNA, 20 bp, Artificial Sequence
  Description of Artificial Sequence: Synthetic oligonucleotide
  Target: ATXN1; (+) strand; PAM type: YTN; PAM sequence: CTT
ttgctgcacgttttattctt

SEQ ID NO: 309347 - DNA, 20 bp, Artificial Sequence
  Description of Artificial Sequence: Synthetic oligonucleotide
  Target: ATXN1; (+) strand; PAM type: YTN; PAM sequence: TTT
tgctgcacgttttattctta

SEQ ID NO: 309348 - DNA, 20 bp, Artificial Sequence
  Description of Artificial Sequence: Synthetic oligonucleotide
  Target: ATXN1; (+) strand; PAM type: YTN; PAM sequence: TTT
gctgcacgttttattcttag

SEQ ID NO: 309349 - DNA, 20 bp, Artificial Sequence
  Description of Artificial Sequence: Synthetic oligonucleotide
  Target: ATXN1; (+) strand; PAM type: YTN; PAM sequence: TTG
ctgcacgttttattcttaga

SEQ ID NO: 309350 - DNA, 20 bp, Artificial Sequence
  Description of Artificial Sequence: Synthetic oligonucleotide
  Target: ATXN1; (+) strand; PAM type: YTN; PAM sequence: CTG
cacgttttattcttagagct

SEQ ID NO: 309351 - DNA, 20 bp, Artificial Sequence
  Description of Artificial Sequence: Synthetic oligonucleotide
  Target: ATXN1; (+) strand; PAM type: YTN; PAM sequence: TTT
tattcttagagcttgcgttc

SEQ ID NO: 309352 - DNA, 20 bp, Artificial Sequence
  Description of Artificial Sequence: Synthetic oligonucleotide
  Target: ATXN1; (+) strand; PAM type: YTN; PAM sequence: TTT
attcttagagcttgcgttca

SEQ ID NO: 309353 - DNA, 20 bp, Artificial Sequence
  Description of Artificial Sequence: Synthetic oligonucleotide
  Target: ATXN1; (+) strand; PAM type: YTN; PAM sequence: TTA
ttcttagagcttgcgttcag

SEQ ID NO: 309354 - DNA, 20 bp, Artificial Sequence
  Description of Artificial Sequence: Synthetic oligonucleotide
  Target: ATXN1; (+) strand; PAM type: YTN; PAM sequence: TTC
ttagagcttgcgttcagcgc

SEQ ID NO: 309355 - DNA, 20 bp, Artificial Sequence
  Description of Artificial Sequence: Synthetic oligonucleotide
  Target: ATXN1; (+) strand; PAM type: YTN; PAM sequence: CTT
agagcttgcgttcagcgcca

SEQ ID NO: 309356 - DNA, 20 bp, Artificial Sequence
  Description of Artificial Sequence: Synthetic oligonucleotide
  Target: ATXN1; (+) strand; PAM type: YTN; PAM sequence: TTA
gagcttgcgttcagcgccac

SEQ ID NO: 309357 - DNA, 20 bp, Artificial Sequence
  Description of Artificial Sequence: Synthetic oligonucleotide
  Target: ATXN1; (+) strand; PAM type: YTN; PAM sequence: CTT
gcgttcagcgccacaccacc

SEQ ID NO: 309358 - DNA, 20 bp, Artificial Sequence
  Description of Artificial Sequence: Synthetic oligonucleotide
  Target: ATXN1; (+) strand; PAM type: YTN; PAM sequence: TTG
cgttcagcgccacaccacca

SEQ ID NO: 309359 - DNA, 20 bp, Artificial Sequence
  Description of Artificial Sequence: Synthetic oligonucleotide
  Target: ATXN1; (+) strand; PAM type: YTN; PAM sequence: TTC
agcgccacaccaccacctat

SEQ ID NO: 309360 - DNA, 20 bp, Artificial Sequence
  Description of Artificial Sequence: Synthetic oligonucleotide
  Target: ATXN1; (+) strand; PAM type: YTN; PAM sequence: CTA
tcacactggagagacaaata

SEQ ID NO: 309361 - DNA, 20 bp, Artificial Sequence
  Description of Artificial Sequence: Synthetic oligonucleotide
  Target: ATXN1; (+) strand; PAM type: YTN; PAM sequence: CTG
gagagacaaatagttcatat

SEQ ID NO: 309362 - DNA, 20 bp, Artificial Sequence
  Description of Artificial Sequence: Synthetic oligonucleotide
  Target: ATXN1; (+) strand; PAM type: YTN; PAM sequence: TTC
atatctgccaaatcttgcaa

SEQ ID NO: 309363 - DNA, 20 bp, Artificial Sequence
  Description of Artificial Sequence: Synthetic oligonucleotide
  Target: ATXN1; (+) strand; PAM type: YTN; PAM sequence: CTG
ccaaatcttgcaagctgagc

SEQ ID NO: 309364 - DNA, 20 bp, Artificial Sequence
  Description of Artificial Sequence: Synthetic oligonucleotide
  Target: ATXN1; (+) strand; PAM type: YTN; PAM sequence: CTT
gcaagctgagcaatgaccca

SEQ ID NO: 309365 - DNA, 20 bp, Artificial Sequence
  Description of Artificial Sequence: Synthetic oligonucleotide
  Target: ATXN1; (+) strand; PAM type: YTN; PAM sequence: TTG
caagctgagcaatgacccag

SEQ ID NO: 309366 - DNA, 20 bp, Artificial Sequence
  Description of Artificial Sequence: Synthetic oligonucleotide
  Target: ATXN1; (+) strand; PAM type: YTN; PAM sequence: CTG
agcaatgacccagtgaagtt

SEQ ID NO: 309367 - DNA, 20 bp, Artificial Sequence
  Description of Artificial Sequence: Synthetic oligonucleotide
  Target: ATXN1; (+) strand; PAM type: YTN; PAM sequence: TTC
ttttaagagtcaaaagttca

SEQ ID NO: 309368 - DNA, 20 bp, Artificial Sequence
  Description of Artificial Sequence: Synthetic oligonucleotide
  Target: ATXN1; (+) strand; PAM type: YTN; PAM sequence: CTT
ttaagagtcaaaagttcatc

SEQ ID NO: 309369 - DNA, 20 bp, Artificial Sequence
  Description of Artificial Sequence: Synthetic oligonucleotide
  Target: ATXN1; (+) strand; PAM type: YTN; PAM sequence: TTT
taagagtcaaaagttcatca

SEQ ID NO: 309370 - DNA, 20 bp, Artificial Sequence
  Description of Artificial Sequence: Synthetic oligonucleotide
  Target: ATXN1; (+) strand; PAM type: YTN; PAM sequence: TTT
aagagtcaaaagttcatcat

SEQ ID NO: 309371 - DNA, 20 bp, Artificial Sequence
  Description of Artificial Sequence: Synthetic oligonucleotide
  Target: ATXN1; (+) strand; PAM type: YTN; PAM sequence: TTA
agagtcaaaagttcatcatc

SEQ ID NO: 309372 - DNA, 20 bp, Artificial Sequence
  Description of Artificial Sequence: Synthetic oligonucleotide
  Target: ATXN1; (+) strand; PAM type: YTN; PAM sequence: TTC
atcatctcgctgagactctt

SEQ ID NO: 309373 - DNA, 20 bp, Artificial Sequence
  Description of Artificial Sequence: Synthetic oligonucleotide
  Target: ATXN1; (+) strand; PAM type: YTN; PAM sequence: CTC
gctgagactcttgatgctga

SEQ ID NO: 309374 - DNA, 20 bp, Artificial Sequence
  Description of Artificial Sequence: Synthetic oligonucleotide
  Target: ATXN1; (+) strand; PAM type: YTN; PAM sequence: CTG
agactcttgatgctgaataa

SEQ ID NO: 309375 - DNA, 20 bp, Artificial Sequence
  Description of Artificial Sequence: Synthetic oligonucleotide
  Target: ATXN1; (+) strand; PAM type: YTN; PAM sequence: CTC
ttgatgctgaataacatttg

SEQ ID NO: 309376 - DNA, 20 bp, Artificial Sequence
  Description of Artificial Sequence: Synthetic oligonucleotide
  Target: ATXN1; (+) strand; PAM type: YTN; PAM sequence: CTT
gatgctgaataacatttgga

SEQ ID NO: 309377 - DNA, 20 bp, Artificial Sequence
  Description of Artificial Sequence: Synthetic oligonucleotide
  Target: ATXN1; (+) strand; PAM type: YTN; PAM sequence: TTG
atgctgaataacatttggat

SEQ ID NO: 309378 - DNA, 20 bp, Artificial Sequence
  Description of Artificial Sequence: Synthetic oligonucleotide
  Target: ATXN1; (+) strand; PAM type: YTN; PAM sequence: CTG
aataacatttggatccaact

SEQ ID NO: 309379 - DNA, 20 bp, Artificial Sequence
  Description of Artificial Sequence: Synthetic oligonucleotide
  Target: ATXN1; (+) strand; PAM type: YTN; PAM sequence: TTT
ggatccaacttaagccaatc

SEQ ID NO: 309380 - DNA, 20 bp, Artificial Sequence
  Description of Artificial Sequence: Synthetic oligonucleotide
  Target: ATXN1; (+) strand; PAM type: YTN; PAM sequence: TTG
gatccaacttaagccaatcc

SEQ ID NO: 309381 - DNA, 20 bp, Artificial Sequence
  Description of Artificial Sequence: Synthetic oligonucleotide
  Target: ATXN1; (+) strand; PAM type: YTN; PAM sequence: CTT
aagccaatcccctgaaacgg

SEQ ID NO: 309382 - DNA, 20 bp, Artificial Sequence
  Description of Artificial Sequence: Synthetic oligonucleotide
  Target: ATXN1; (+) strand; PAM type: YTN; PAM sequence: TTA
agccaatcccctgaaacgga

SEQ ID NO: 309383 - DNA, 20 bp, Artificial Sequence
  Description of Artificial Sequence: Synthetic oligonucleotide
  Target: ATXN1; (+) strand; PAM type: YTN; PAM sequence: CTG
aaacggataagcaaattgcc

SEQ ID NO: 309384 - DNA, 20 bp, Artificial Sequence
  Description of Artificial Sequence: Synthetic oligonucleotide
  Target: ATXN1; (+) strand; PAM type: YTN; PAM sequence: TTG
ccactgtcatcattttcttc

SEQ ID NO: 309385 - DNA, 20 bp, Artificial Sequence
  Description of Artificial Sequence: Synthetic oligonucleotide
  Target: ATXN1; (+) strand; PAM type: YTN; PAM sequence: CTG
tcatcattttcttcaattaa

SEQ ID NO: 309386 - DNA, 20 bp, Artificial Sequence
  Description of Artificial Sequence: Synthetic oligonucleotide
  Target: ATXN1; (+) strand; PAM type: YTN; PAM sequence: TTT
tcttcaattaataattattg

SEQ ID NO: 309387 - DNA, 20 bp, Artificial Sequence
  Description of Artificial Sequence: Synthetic oligonucleotide
  Target: ATXN1; (+) strand; PAM type: YTN; PAM sequence: TTT
cttcaattaataattattga

SEQ ID NO: 309388 - DNA, 20 bp, Artificial Sequence
  Description of Artificial Sequence: Synthetic oligonucleotide
  Target: ATXN1; (+) strand; PAM type: YTN; PAM sequence: TTC
ttcaattaataattattgaa

SEQ ID NO: 309389 - DNA, 20 bp, Artificial Sequence
  Description of Artificial Sequence: Synthetic oligonucleotide
  Target: ATXN1; (+) strand; PAM type: YTN; PAM sequence: CTT
caattaataattattgaaag

SEQ ID NO: 309390 - DNA, 20 bp, Artificial Sequence
  Description of Artificial Sequence: Synthetic oligonucleotide
  Target: ATXN1; (+) strand; PAM type: YTN; PAM sequence: TTC
aattaataattattgaaagt

SEQ ID NO: 309391 - DNA, 20 bp, Artificial Sequence
  Description of Artificial Sequence: Synthetic oligonucleotide
  Target: ATXN1; (+) strand; PAM type: YTN; PAM sequence: TTA
ataattattgaaagtgcata

SEQ ID NO: 309392 - DNA, 20 bp, Artificial Sequence
  Description of Artificial Sequence: Synthetic oligonucleotide
  Target: ATXN1; (+) strand; PAM type: YTN; PAM sequence: TTA
ttgaaagtgcataggaatct

SEQ ID NO: 309393 - DNA, 20 bp, Artificial Sequence
  Description of Artificial Sequence: Synthetic oligonucleotide
  Target: ATXN1; (+) strand; PAM type: YTN; PAM sequence: TTG
aaagtgcataggaatctcaa

SEQ ID NO: 309394 - DNA, 20 bp, Artificial Sequence
  Description of Artificial Sequence: Synthetic oligonucleotide
  Target: ATXN1; (+) strand; PAM type: YTN; PAM sequence: CTC
aaggagatatgagtaagagt

SEQ ID NO: 309395 - DNA, 20 bp, Artificial Sequence
  Description of Artificial Sequence: Synthetic oligonucleotide
  Target: ATXN1; (+) strand; PAM type: YTN; PAM sequence: CTG
catgggacagcctgtgtcag

SEQ ID NO: 309396 - DNA, 20 bp, Artificial Sequence
  Description of Artificial Sequence: Synthetic oligonucleotide
  Target: ATXN1; (+) strand; PAM type: YTN; PAM sequence: CTG
tgtcagaaagctcatatgtg

SEQ ID NO: 309397 - DNA, 20 bp, Artificial Sequence
  Description of Artificial Sequence: Synthetic oligonucleotide
  Target: ATXN1; (+) strand; PAM type: YTN; PAM sequence: CTC
atatgtgactgaacagacag

SEQ ID NO: 309398 - DNA, 20 bp, Artificial Sequence
  Description of Artificial Sequence: Synthetic oligonucleotide
  Target: ATXN1; (+) strand; PAM type: YTN; PAM sequence: CTG
aacagacaggcaggcatcaa

SEQ ID NO: 309399 - DNA, 20 bp, Artificial Sequence
  Description of Artificial Sequence: Synthetic oligonucleotide
  Target: ATXN1; (+) strand; PAM type: YTN; PAM sequence: CTC
caaggaaggacccttccttg

SEQ ID NO: 309400 - DNA, 20 bp, Artificial Sequence
  Description of Artificial Sequence: Synthetic oligonucleotide
  Target: ATXN1; (+) strand; PAM type: YTN; PAM sequence: CTT
ccttgatcctgacttcctag

SEQ ID NO: 309401 - DNA, 20 bp, Artificial Sequence
  Description of Artificial Sequence: Synthetic oligonucleotide
  Target: ATXN1; (+) strand; PAM type: YTN; PAM sequence: TTC
cttgatcctgacttcctaga

SEQ ID NO: 309402 - DNA, 20 bp, Artificial Sequence
  Description of Artificial Sequence: Synthetic oligonucleotide
  Target: ATXN1; (+) strand; PAM type: YTN; PAM sequence: CTT
gatcctgacttcctagactg

SEQ ID NO: 309403 - DNA, 20 bp, Artificial Sequence
  Description of Artificial Sequence: Synthetic oligonucleotide
  Target: ATXN1; (+) strand; PAM type: YTN; PAM sequence: TTG
atcctgacttcctagactgt

SEQ ID NO: 309404 - DNA, 20 bp, Artificial Sequence
  Description of Artificial Sequence: Synthetic oligonucleotide
  Target: ATXN1; (+) strand; PAM type: YTN; PAM sequence: CTG
acttcctagactgtgttacc

SEQ ID NO: 309405 - DNA, 20 bp, Artificial Sequence
  Description of Artificial Sequence: Synthetic oligonucleotide
  Target: ATXN1; (+) strand; PAM type: YTN; PAM sequence: CTT
cctagactgtgttacctgtg

SEQ ID NO: 309406 - DNA, 20 bp, Artificial Sequence
  Description of Artificial Sequence: Synthetic oligonucleotide
  Target: ATXN1; (+) strand; PAM type: YTN; PAM sequence: TTC
ctagactgtgttacctgtgt

SEQ ID NO: 309407 - DNA, 20 bp, Artificial Sequence
  Description of Artificial Sequence: Synthetic oligonucleotide
  Target: ATXN1; (+) strand; PAM type: YTN; PAM sequence: CTA
gactgtgttacctgtgtcat

SEQ ID NO: 309408 - DNA, 20 bp, Artificial Sequence
  Description of Artificial Sequence: Synthetic oligonucleotide
  Target: ATXN1; (+) strand; PAM type: YTN; PAM sequence: CTG
tgttacctgtgtcatggctc

SEQ ID NO: 309409 - DNA, 20 bp, Artificial Sequence
  Description of Artificial Sequence: Synthetic oligonucleotide
  Target: ATXN1; (+) strand; PAM type: YTN; PAM sequence: TTA
cctgtgtcatggctctttaa

SEQ ID NO: 309410 - DNA, 20 bp, Artificial Sequence
  Description of Artificial Sequence: Synthetic oligonucleotide
  Target: ATXN1; (+) strand; PAM type: YTN; PAM sequence: CTG
tgtcatggctctttaaatat

SEQ ID NO: 309411 - DNA, 20 bp, Artificial Sequence
  Description of Artificial Sequence: Synthetic oligonucleotide
  Target: ATXN1; (+) strand; PAM type: YTN; PAM sequence: CTC
tttaaatattactccaagcc

SEQ ID NO: 309412 - DNA, 20 bp, Artificial Sequence
  Description of Artificial Sequence: Synthetic oligonucleotide
  Target: ATXN1; (+) strand; PAM type: YTN; PAM sequence: CTT
taaatattactccaagccat

SEQ ID NO: 309413 - DNA, 20 bp, Artificial Sequence
  Description of Artificial Sequence: Synthetic oligonucleotide
  Target: ATXN1; (+) strand; PAM type: YTN; PAM sequence: TTT
aaatattactccaagccatg

SEQ ID NO: 309414 - DNA, 20 bp, Artificial Sequence
  Description of Artificial Sequence: Synthetic oligonucleotide
  Target: ATXN1; (+) strand; PAM type: YTN; PAM sequence: TTA
aatattactccaagccatgc

SEQ ID NO: 309415 - DNA, 20 bp, Artificial Sequence
  Description of Artificial Sequence: Synthetic oligonucleotide
  Target: ATXN1; (+) strand; PAM type: YTN; PAM sequence: TTA
ctccaagccatgccttgcct

SEQ ID NO: 309416 - DNA, 20 bp, Artificial Sequence
  Description of Artificial Sequence: Synthetic oligonucleotide
  Target: ATXN1; (+) strand; PAM type: YTN; PAM sequence: CTC
caagccatgccttgccttat

SEQ ID NO: 309417 - DNA, 20 bp, Artificial Sequence
  Description of Artificial Sequence: Synthetic oligonucleotide
  Target: ATXN1; (+) strand; PAM type: YTN; PAM sequence: CTT
gccttatgcactcgactgta

SEQ ID NO: 309418 - DNA, 20 bp, Artificial Sequence
  Description of Artificial Sequence: Synthetic oligonucleotide
  Target: ATXN1; (+) strand; PAM type: YTN; PAM sequence: TTG
ccttatgcactcgactgtaa

SEQ ID NO: 309419 - DNA, 20 bp, Artificial Sequence
  Description of Artificial Sequence: Synthetic oligonucleotide
  Target: ATXN1; (+) strand; PAM type: YTN; PAM sequence: CTT
atgcactcgactgtaagctt

SEQ ID NO: 309420 - DNA, 20 bp, Artificial Sequence
  Description of Artificial Sequence: Synthetic oligonucleotide
  Target: ATXN1; (+) strand; PAM type: YTN; PAM sequence: TTA
tgcactcgactgtaagcttc

SEQ ID NO: 309421 - DNA, 20 bp, Artificial Sequence
  Description of Artificial Sequence: Synthetic oligonucleotide
  Target: ATXN1; (+) strand; PAM type: YTN; PAM sequence: CTC
gactgtaagcttcttaagga

SEQ ID NO: 309422 - DNA, 20 bp, Artificial Sequence
  Description of Artificial Sequence: Synthetic oligonucleotide
  Target: ATXN1; (+) strand; PAM type: YTN; PAM sequence: CTG
taagcttcttaaggacaggg

SEQ ID NO: 309423 - DNA, 20 bp, Artificial Sequence
  Description of Artificial Sequence: Synthetic oligonucleotide
  Target: ATXN1; (+) strand; PAM type: YTN; PAM sequence: CTT
cttaaggacagggcttaagg

SEQ ID NO: 309424 - DNA, 20 bp, Artificial Sequence
  Description of Artificial Sequence: Synthetic oligonucleotide
  Target: ATXN1; (+) strand; PAM type: YTN; PAM sequence: TTC
ttaaggacagggcttaagga

SEQ ID NO: 309425 - DNA, 20 bp, Artificial Sequence
  Description of Artificial Sequence: Synthetic oligonucleotide
  Target: ATXN1; (+) strand; PAM type: YTN; PAM sequence: CTT
aaggacagggcttaaggaac

SEQ ID NO: 309426 - DNA, 20 bp, Artificial Sequence
  Description of Artificial Sequence: Synthetic oligonucleotide
  Target: ATXN1; (+) strand; PAM type: YTN; PAM sequence: TTA
aggacagggcttaaggaaca

SEQ ID NO: 309427 - DNA, 20 bp, Artificial Sequence
  Description of Artificial Sequence: Synthetic oligonucleotide
  Target: ATXN1; (+) strand; PAM type: YTN; PAM sequence: CTT
aaggaacagggctgagagtg

SEQ ID NO: 309428 - DNA, 20 bp, Artificial Sequence
  Description of Artificial Sequence: Synthetic oligonucleotide
  Target: ATXN1; (+) strand; PAM type: YTN; PAM sequence: TTA
aggaacagggctgagagtgt

SEQ ID NO: 309429 - DNA, 20 bp, Artificial Sequence
  Description of Artificial Sequence: Synthetic oligonucleotide
  Target: ATXN1; (+) strand; PAM type: YTN; PAM sequence: CTG
agagtgtagactgggatcca

SEQ ID NO: 309430 - DNA, 20 bp, Artificial Sequence
  Description of Artificial Sequence: Synthetic oligonucleotide
  Target: ATXN1; (+) strand; PAM type: YTN; PAM sequence: CTG
ggatccaagcacgattctat

SEQ ID NO: 309431 - DNA, 20 bp, Artificial Sequence
  Description of Artificial Sequence: Synthetic oligonucleotide
  Target: ATXN1; (+) strand; PAM type: YTN; PAM sequence: TTC
tatcacttaacagctgggaa

SEQ ID NO: 309432 - DNA, 20 bp, Artificial Sequence
  Description of Artificial Sequence: Synthetic oligonucleotide
  Target: ATXN1; (+) strand; PAM type: YTN; PAM sequence: CTA
tcacttaacagctgggaaac

SEQ ID NO: 309433 - DNA, 20 bp, Artificial Sequence
  Description of Artificial Sequence: Synthetic oligonucleotide
  Target: ATXN1; (+) strand; PAM type: YTN; PAM sequence: CTT
aacagctgggaaaccttggg

SEQ ID NO: 309434 - DNA, 20 bp, Artificial Sequence
  Description of Artificial Sequence: Synthetic oligonucleotide
  Target: ATXN1; (+) strand; PAM type: YTN; PAM sequence: TTA
acagctgggaaaccttgggg

SEQ ID NO: 309435 - DNA, 20 bp, Artificial Sequence
  Description of Artificial Sequence: Synthetic oligonucleotide
  Target: ATXN1; (+) strand; PAM type: YTN; PAM sequence: CTG
ggaaaccttggggaaattat

SEQ ID NO: 309436 - DNA, 20 bp, Artificial Sequence
  Description of Artificial Sequence: Synthetic oligonucleotide
  Target: ATXN1; (+) strand; PAM type: YTN; PAM sequence: CTT
ggggaaattattcaccctct

SEQ ID NO: 309437 - DNA, 20 bp, Artificial Sequence
  Description of Artificial Sequence: Synthetic oligonucleotide
  Target: ATXN1; (+) strand; PAM type: YTN; PAM sequence: TTG
gggaaattattcaccctctc

SEQ ID NO: 309438 - DNA, 20 bp, Artificial Sequence
  Description of Artificial Sequence: Synthetic oligonucleotide
  Target: ATXN1; (+) strand; PAM type: YTN; PAM sequence: TTA
ttcaccctctctgtgccaca

SEQ ID NO: 309439 - DNA, 20 bp, Artificial Sequence
  Description of Artificial Sequence: Synthetic oligonucleotide
  Target: ATXN1; (+) strand; PAM type: YTN; PAM sequence: TTC
accctctctgtgccacagtt

SEQ ID NO: 309440 - DNA, 20 bp, Artificial Sequence
  Description of Artificial Sequence: Synthetic oligonucleotide
  Target: ATXN1; (+) strand; PAM type: YTN; PAM sequence: CTC
tctgtgccacagtttcctcg

SEQ ID NO: 309441 - DNA, 20 bp, Artificial Sequence
  Description of Artificial Sequence: Synthetic oligonucleotide
  Target: ATXN1; (+) strand; PAM type: YTN; PAM sequence: CTC
tgtgccacagtttcctcgcc

SEQ ID NO: 309442 - DNA, 20 bp, Artificial Sequence
  Description of Artificial Sequence: Synthetic oligonucleotide
  Target: ATXN1; (+) strand; PAM type: YTN; PAM sequence: CTG
tgccacagtttcctcgcctg

SEQ ID NO: 309443 - DNA, 20 bp, Artificial Sequence
  Description of Artificial Sequence: Synthetic oligonucleotide
  Target: ATXN1; (+) strand; PAM type: YTN; PAM sequence: TTT
cctcgcctgtgcaatggaga

SEQ ID NO: 309444 - DNA, 20 bp, Artificial Sequence
  Description of Artificial Sequence: Synthetic oligonucleotide
  Target: ATXN1; (+) strand; PAM type: YTN; PAM sequence: TTC
ctcgcctgtgcaatggagaa

SEQ ID NO: 309445 - DNA, 20 bp, Artificial Sequence
  Description of Artificial Sequence: Synthetic oligonucleotide
  Target: ATXN1; (+) strand; PAM type: YTN; PAM sequence: CTC
gcctgtgcaatggagaaaat

SEQ ID NO: 309446 - DNA, 20 bp, Artificial Sequence
  Description of Artificial Sequence: Synthetic oligonucleotide
  Target: ATXN1; (+) strand; PAM type: YTN; PAM sequence: CTG
tgcaatggagaaaataatga

SEQ ID NO: 309447 - DNA, 20 bp, Artificial Sequence
  Description of Artificial Sequence: Synthetic oligonucleotide
  Target: ATXN1; (+) strand; PAM type: YTN; PAM sequence: CTA
cctcaaaggactgtaatgag

SEQ ID NO: 309448 - DNA, 20 bp, Artificial Sequence
  Description of Artificial Sequence: Synthetic oligonucleotide
  Target: ATXN1; (+) strand; PAM type: YTN; PAM sequence: CTC
aaaggactgtaatgaggatt

SEQ ID NO: 309449 - DNA, 20 bp, Artificial Sequence
  Description of Artificial Sequence: Synthetic oligonucleotide
  Target: ATXN1; (+) strand; PAM type: YTN; PAM sequence: CTG
taatgaggattcaataagtt

SEQ ID NO: 309450 - DNA, 20 bp, Artificial Sequence
  Description of Artificial Sequence: Synthetic oligonucleotide
  Target: ATXN1; (+) strand; PAM type: YTN; PAM sequence: TTC
aataagttaatatgcagaat

SEQ ID NO: 309451 - DNA, 20 bp, Artificial Sequence
  Description of Artificial Sequence: Synthetic oligonucleotide
  Target: ATXN1; (+) strand; PAM type: YTN; PAM sequence: TTA
atatgcagaatagtaaatgt

SEQ ID NO: 309452 - DNA, 20 bp, Artificial Sequence
  Description of Artificial Sequence: Synthetic oligonucleotide
  Target: ATXN1; (+) strand; PAM type: YTN; PAM sequence: CTA
ttgatcatctccatattccc

SEQ ID NO: 309453 - DNA, 20 bp, Artificial Sequence
  Description of Artificial Sequence: Synthetic oligonucleotide
  Target: ATXN1; (+) strand; PAM type: YTN; PAM sequence: TTG
atcatctccatattccctag

SEQ ID NO: 309454 - DNA, 20 bp, Artificial Sequence
  Description of Artificial Sequence: Synthetic oligonucleotide
  Target: ATXN1; (+) strand; PAM type: YTN; PAM sequence: CTC
catattccctagagggcctt

SEQ ID NO: 309455 - DNA, 20 bp, Artificial Sequence
  Description of Artificial Sequence: Synthetic oligonucleotide
  Target: ATXN1; (+) strand; PAM type: YTN; PAM sequence: TTC
cctagagggccttgttggca

SEQ ID NO: 309456 - DNA, 20 bp, Artificial Sequence
  Description of Artificial Sequence: Synthetic oligonucleotide
  Target: ATXN1; (+) strand; PAM type: YTN; PAM sequence: CTA
gagggccttgttggcataat

SEQ ID NO: 309457 - DNA, 20 bp, Artificial Sequence
  Description of Artificial Sequence: Synthetic oligonucleotide
  Target: ATXN1; (+) strand; PAM type: YTN; PAM sequence: CTT
gttggcataatgcgtctcat

SEQ ID NO: 309458 - DNA, 20 bp, Artificial Sequence
  Description of Artificial Sequence: Synthetic oligonucleotide
  Target: ATXN1; (+) strand; PAM type: YTN; PAM sequence: TTG
ttggcataatgcgtctcata

SEQ ID NO: 309459 - DNA, 20 bp, Artificial Sequence
  Description of Artificial Sequence: Synthetic oligonucleotide
  Target: ATXN1; (+) strand; PAM type: YTN; PAM sequence: TTG
gcataatgcgtctcatacat

SEQ ID NO: 309460 - DNA, 20 bp, Artificial Sequence
  Description of Artificial Sequence: Synthetic oligonucleotide
  Target: ATXN1; (+) strand; PAM type: YTN; PAM sequence: CTC
atacattagatgctcattaa

SEQ ID NO: 309461 - DNA, 20 bp, Artificial Sequence
  Description of Artificial Sequence: Synthetic oligonucleotide
  Target: ATXN1; (+) strand; PAM type: YTN; PAM sequence: TTA
gatgctcattaaataattgc

SEQ ID NO: 309462 - DNA, 20 bp, Artificial Sequence
  Description of Artificial Sequence: Synthetic oligonucleotide
  Target: ATXN1; (+) strand; PAM type: YTN; PAM sequence: CTC
attaaataattgcagacaag

SEQ ID NO: 309463 - DNA, 20 bp, Artificial Sequence
  Description of Artificial Sequence: Synthetic oligonucleotide
  Target: ATXN1; (+) strand; PAM type: YTN; PAM sequence: TTA
aataattgcagacaagaacg

SEQ ID NO: 309464 - DNA, 20 bp, Artificial Sequence
  Description of Artificial Sequence: Synthetic oligonucleotide
  Target: ATXN1; (+) strand; PAM type: YTN; PAM sequence: TTG
cagacaagaacgatctgccc

SEQ ID NO: 309465 - DNA, 20 bp, Artificial Sequence
  Description of Artificial Sequence: Synthetic oligonucleotide
  Target: ATXN1; (+) strand; PAM type: YTN; PAM sequence: CTG
cccctggagttgtttgctcc

SEQ ID NO: 309466 - DNA, 20 bp, Artificial Sequence
  Description of Artificial Sequence: Synthetic oligonucleotide
  Target: ATXN1; (+) strand; PAM type: YTN; PAM sequence: CTG
gagttgtttgctccatccct

SEQ ID NO: 309467 - DNA, 20 bp, Artificial Sequence
  Description of Artificial Sequence: Synthetic oligonucleotide
  Target: ATXN1; (+) strand; PAM type: YTN; PAM sequence: TTG
tttgctccatccctcttgtt

SEQ ID NO: 309468 - DNA, 20 bp, Artificial Sequence
  Description of Artificial Sequence: Synthetic oligonucleotide
  Target: ATXN1; (+) strand; PAM type: YTN; PAM sequence: TTT
gctccatccctcttgttcct

SEQ ID NO: 309469 - DNA, 20 bp, Artificial Sequence
  Description of Artificial Sequence: Synthetic oligonucleotide
  Target: ATXN1; (+) strand; PAM type: YTN; PAM sequence: TTG
ctccatccctcttgttcctg

SEQ ID NO: 309470 - DNA, 20 bp, Artificial Sequence
  Description of Artificial Sequence: Synthetic oligonucleotide
  Target: ATXN1; (+) strand; PAM type: YTN; PAM sequence: CTC
catccctcttgttcctgtct

SEQ ID NO: 309471 - DNA, 20 bp, Artificial Sequence
  Description of Artificial Sequence: Synthetic oligonucleotide
  Target: ATXN1; (+) strand; PAM type: YTN; PAM sequence: CTC
ttgttcctgtcttaaccttc

SEQ ID NO: 309472 - DNA, 20 bp, Artificial Sequence
  Description of Artificial Sequence: Synthetic oligonucleotide
  Target: ATXN1; (+) strand; PAM type: YTN; PAM sequence: CTT
gttcctgtcttaaccttctt

SEQ ID NO: 309473 - DNA, 20 bp, Artificial Sequence
  Description of Artificial Sequence: Synthetic oligonucleotide
  Target: ATXN1; (+) strand; PAM type: YTN; PAM sequence: TTG
ttcctgtcttaaccttcttg

SEQ ID NO: 309474 - DNA, 20 bp, Artificial Sequence
  Description of Artificial Sequence: Synthetic oligonucleotide
  Target: ATXN1; (+) strand; PAM type: YTN; PAM sequence: TTC
ctgtcttaaccttcttgtct

SEQ ID NO: 309475 - DNA, 20 bp, Artificial Sequence
  Description of Artificial Sequence: Synthetic oligonucleotide
  Target: ATXN1; (+) strand; PAM type: YTN; PAM sequence: CTG
tcttaaccttcttgtctttg

SEQ ID NO: 309476 - DNA, 20 bp, Artificial Sequence
  Description of Artificial Sequence: Synthetic oligonucleotide
  Target: ATXN1; (+) strand; PAM type: YTN; PAM sequence: CTT
aaccttcttgtctttgatga

SEQ ID NO: 309477 - DNA, 20 bp, Artificial Sequence
  Description of Artificial Sequence: Synthetic oligonucleotide
  Target: ATXN1; (+) strand; PAM type: YTN; PAM sequence: TTA
accttcttgtctttgatgaa

SEQ ID NO: 309478 - DNA, 20 bp, Artificial Sequence
  Description of Artificial Sequence: Synthetic oligonucleotide
  Target: ATXN1; (+) strand; PAM type: YTN; PAM sequence: CTT
cttgtctttgatgaaagtta

SEQ ID NO: 309479 - DNA, 20 bp, Artificial Sequence
  Description of Artificial Sequence: Synthetic oligonucleotide
  Target: ATXN1; (+) strand; PAM type: YTN; PAM sequence: TTC
ttgtctttgatgaaagttaa

SEQ ID NO: 309480 - DNA, 20 bp, Artificial Sequence
  Description of Artificial Sequence: Synthetic oligonucleotide
  Target: ATXN1; (+) strand; PAM type: YTN; PAM sequence: CTT
gtctttgatgaaagttaaat

SEQ ID NO: 309481 - DNA, 20 bp, Artificial Sequence
  Description of Artificial Sequence: Synthetic oligonucleotide
  Target: ATXN1; (+) strand; PAM type: YTN; PAM sequence: TTG
tctttgatgaaagttaaata

SEQ ID NO: 309482 - DNA, 20 bp, Artificial Sequence
  Description of Artificial Sequence: Synthetic oligonucleotide
  Target: ATXN1; (+) strand; PAM type: YTN; PAM sequence: CTT
tgatgaaagttaaataagtc

SEQ ID NO: 309483 - DNA, 20 bp, Artificial Sequence
  Description of Artificial Sequence: Synthetic oligonucleotide
  Target: ATXN1; (+) strand; PAM type: YTN; PAM sequence: TTT
gatgaaagttaaataagtca

SEQ ID NO: 309484 - DNA, 20 bp, Artificial Sequence
  Description of Artificial Sequence: Synthetic oligonucleotide
  Target: ATXN1; (+) strand; PAM type: YTN; PAM sequence: TTG
atgaaagttaaataagtcac

SEQ ID NO: 309485 - DNA, 20 bp, Artificial Sequence
  Description of Artificial Sequence: Synthetic oligonucleotide
  Target: ATXN1; (+) strand; PAM type: YTN; PAM sequence: TTA
aataagtcactgcttttatt

SEQ ID NO: 309486 - DNA, 20 bp, Artificial Sequence
  Description of Artificial Sequence: Synthetic oligonucleotide
  Target: ATXN1; (+) strand; PAM type: YTN; PAM sequence: CTG
cttttattctgagccctttt

SEQ ID NO: 309487 - DNA, 20 bp, Artificial Sequence
  Description of Artificial Sequence: Synthetic oligonucleotide
  Target: ATXN1; (+) strand; PAM type: YTN; PAM sequence: CTT
ttattctgagcccttttggg

SEQ ID NO: 309488 - DNA, 20 bp, Artificial Sequence
  Description of Artificial Sequence: Synthetic oligonucleotide
  Target: ATXN1; (+) strand; PAM type: YTN; PAM sequence: TTT
tattctgagcccttttgggc

SEQ ID NO: 309489 - DNA, 20 bp, Artificial Sequence
  Description of Artificial Sequence: Synthetic oligonucleotide
  Target: ATXN1; (+) strand; PAM type: YTN; PAM sequence: TTT
attctgagcccttttgggct

SEQ ID NO: 309490 - DNA, 20 bp, Artificial Sequence
  Description of Artificial Sequence: Synthetic oligonucleotide
  Target: ATXN1; (+) strand; PAM type: YTN; PAM sequence: TTA
ttctgagcccttttgggcta

SEQ ID NO: 309491 - DNA, 20 bp, Artificial Sequence
  Description of Artificial Sequence: Synthetic oligonucleotide
  Target: ATXN1; (+) strand; PAM type: YTN; PAM sequence: TTC
tgagcccttttgggctacac

SEQ ID NO: 309492 - DNA, 20 bp, Artificial Sequence
  Description of Artificial Sequence: Synthetic oligonucleotide
  Target: ATXN1; (+) strand; PAM type: YTN; PAM sequence: CTG
agcccttttgggctacacag

SEQ ID NO: 309493 - DNA, 20 bp, Artificial Sequence
  Description of Artificial Sequence: Synthetic oligonucleotide
  Target: ATXN1; (+) strand; PAM type: YTN; PAM sequence: CTT
ttgggctacacagagagccc

SEQ ID NO: 309494 - DNA, 20 bp, Artificial Sequence
  Description of Artificial Sequence: Synthetic oligonucleotide
  Target: ATXN1; (+) strand; PAM type: YTN; PAM sequence: TTT
tgggctacacagagagccca

SEQ ID NO: 309495 - DNA, 20 bp, Artificial Sequence
  Description of Artificial Sequence: Synthetic oligonucleotide
  Target: ATXN1; (+) strand; PAM type: YTN; PAM sequence: TTT
gggctacacagagagcccat

SEQ ID NO: 309496 - DNA, 20 bp, Artificial Sequence
  Description of Artificial Sequence: Synthetic oligonucleotide
  Target: ATXN1; (+) strand; PAM type: YTN; PAM sequence: TTG
ggctacacagagagcccatc

SEQ ID NO: 309497 - DNA, 20 bp, Artificial Sequence
  Description of Artificial Sequence: Synthetic oligonucleotide
  Target: ATXN1; (+) strand; PAM type: YTN; PAM sequence: CTA
cacagagagcccatcctaac

SEQ ID NO: 309498 - DNA, 20 bp, Artificial Sequence
  Description of Artificial Sequence: Synthetic oligonucleotide
  Target: ATXN1; (+) strand; PAM type: YTN; PAM sequence: CTA
actaactcagcaccaaaaaa

SEQ ID NO: 309499 - DNA, 20 bp, Artificial Sequence
  Description of Artificial Sequence: Synthetic oligonucleotide
  Target: ATXN1; (+) strand; PAM type: YTN; PAM sequence: CTA
actcagcaccaaaaaaaaaa

SEQ ID NO: 309500 - DNA, 20 bp, Artificial Sequence
  Description of Artificial Sequence: Synthetic oligonucleotide
  Target: ATXN1; (+) strand; PAM type: YTN; PAM sequence: CTC
agcaccaaaaaaaaaaacca

SEQ ID NO: 309501 - DNA, 20 bp, Artificial Sequence
  Description of Artificial Sequence: Synthetic oligonucleotide
  Target: ATXN1; (+) strand; PAM type: YTN; PAM sequence: CTT
aatcctcaaattttctctca

SEQ ID NO: 309502 - DNA, 20 bp, Artificial Sequence
  Description of Artificial Sequence: Synthetic oligonucleotide
  Target: ATXN1; (+) strand; PAM type: YTN; PAM sequence: TTA
atcctcaaattttctctcat

SEQ ID NO: 309503 - DNA, 20 bp, Artificial Sequence
  Description of Artificial Sequence: Synthetic oligonucleotide
  Target: ATXN1; (+) strand; PAM type: YTN; PAM sequence: CTC
aaattttctctcattacatt

SEQ ID NO: 309504 - DNA, 20 bp, Artificial Sequence
  Description of Artificial Sequence: Synthetic oligonucleotide
  Target: ATXN1; (+) strand; PAM type: YTN; PAM sequence: TTT
tctctcattacattaaatca

SEQ ID NO: 309505 - DNA, 20 bp, Artificial Sequence
  Description of Artificial Sequence: Synthetic oligonucleotide
  Target: ATXN1; (+) strand; PAM type: YTN; PAM sequence: TTT
ctctcattacattaaatcag

SEQ ID NO: 309506 - DNA, 20 bp, Artificial Sequence
  Description of Artificial Sequence: Synthetic oligonucleotide
  Target: ATXN1; (+) strand; PAM type: YTN; PAM sequence: TTC
tctcattacattaaatcaga

SEQ ID NO: 309507 - DNA, 20 bp, Artificial Sequence
  Description of Artificial Sequence: Synthetic oligonucleotide
  Target: ATXN1; (+) strand; PAM type: YTN; PAM sequence: CTC
tcattacattaaatcagact

SEQ ID NO: 309508 - DNA, 20 bp, Artificial Sequence
  Description of Artificial Sequence: Synthetic oligonucleotide
  Target: ATXN1; (+) strand; PAM type: YTN; PAM sequence: CTC
attacattaaatcagactgc

SEQ ID NO: 309509 - DNA, 20 bp, Artificial Sequence
  Description of Artificial Sequence: Synthetic oligonucleotide
  Target: ATXN1; (+) strand; PAM type: YTN; PAM sequence: TTA
cattaaatcagactgctcac

SEQ ID NO: 309510 - DNA, 20 bp, Artificial Sequence
  Description of Artificial Sequence: Synthetic oligonucleotide
  Target: ATXN1; (+) strand; PAM type: YTN; PAM sequence: TTA
aatcagactgctcactaaca

SEQ ID NO: 309511 - DNA, 20 bp, Artificial Sequence
  Description of Artificial Sequence: Synthetic oligonucleotide
  Target: ATXN1; (+) strand; PAM type: YTN; PAM sequence: CTG
ctcactaacatcatcgtaac

SEQ ID NO: 309512 - DNA, 20 bp, Artificial Sequence
  Description of Artificial Sequence: Synthetic oligonucleotide
  Target: ATXN1; (+) strand; PAM type: YTN; PAM sequence: CTC
actaacatcatcgtaacatc

SEQ ID NO: 309513 - DNA, 20 bp, Artificial Sequence
  Description of Artificial Sequence: Synthetic oligonucleotide
  Target: ATXN1; (+) strand; PAM type: YTN; PAM sequence: CTA
acatcatcgtaacatcatct

SEQ ID NO: 309514 - DNA, 20 bp, Artificial Sequence
  Description of Artificial Sequence: Synthetic oligonucleotide
  Target: ATXN1; (+) strand; PAM type: YTN; PAM sequence: CTC
cagccttctctttcacttta

SEQ ID NO: 309515 - DNA, 20 bp, Artificial Sequence
  Description of Artificial Sequence: Synthetic oligonucleotide
  Target: ATXN1; (+) strand; PAM type: YTN; PAM sequence: CTT
ctctttcactttacatcagg

SEQ ID NO: 309516 - DNA, 20 bp, Artificial Sequence
  Description of Artificial Sequence: Synthetic oligonucleotide
  Target: ATXN1; (+) strand; PAM type: YTN; PAM sequence: TTC
tctttcactttacatcagga

SEQ ID NO: 309517 - DNA, 20 bp, Artificial Sequence
  Description of Artificial Sequence: Synthetic oligonucleotide
  Target: ATXN1; (+) strand; PAM type: YTN; PAM sequence: CTC
tttcactttacatcaggaag

SEQ ID NO: 309518 - DNA, 20 bp, Artificial Sequence
  Description of Artificial Sequence: Synthetic oligonucleotide
  Target: ATXN1; (+) strand; PAM type: YTN; PAM sequence: CTT
tcactttacatcaggaagtc

SEQ ID NO: 309519 - DNA, 20 bp, Artificial Sequence
  Description of Artificial Sequence: Synthetic oligonucleotide
  Target: ATXN1; (+) strand; PAM type: YTN; PAM sequence: TTT
cactttacatcaggaagtct

SEQ ID NO: 309520 - DNA, 20 bp, Artificial Sequence
  Description of Artificial Sequence: Synthetic oligonucleotide
  Target: ATXN1; (+) strand; PAM type: YTN; PAM sequence: TTC
actttacatcaggaagtctt

SEQ ID NO: 309521 - DNA, 20 bp, Artificial Sequence
  Description of Artificial Sequence: Synthetic oligonucleotide
  Target: ATXN1; (+) strand; PAM type: YTN; PAM sequence: CTT
tacatcaggaagtcttagac

SEQ ID NO: 309522 - DNA, 20 bp, Artificial Sequence
  Description of Artificial Sequence: Synthetic oligonucleotide
  Target: ATXN1; (+) strand; PAM type: YTN; PAM sequence: TTT
acatcaggaagtcttagact

SEQ ID NO: 309523 - DNA, 20 bp, Artificial Sequence
  Description of Artificial Sequence: Synthetic oligonucleotide
  Target: ATXN1; (+) strand; PAM type: YTN; PAM sequence: TTA
catcaggaagtcttagacta

SEQ ID NO: 309524 - DNA, 20 bp, Artificial Sequence
  Description of Artificial Sequence: Synthetic oligonucleotide
  Target: ATXN1; (+) strand; PAM type: YTN; PAM sequence: CTT
agactaactttctccccaga

SEQ ID NO: 309525 - DNA, 20 bp, Artificial Sequence
  Description of Artificial Sequence: Synthetic oligonucleotide
  Target: ATXN1; (+) strand; PAM type: YTN; PAM sequence: TTA
gactaactttctccccagac

SEQ ID NO: 309526 - DNA, 20 bp, Artificial Sequence
  Description of Artificial Sequence: Synthetic oligonucleotide
  Target: ATXN1; (+) strand; PAM type: YTN; PAM sequence: CTA
actttctccccagacccaag

SEQ ID NO: 309527 - DNA, 20 bp, Artificial Sequence
  Description of Artificial Sequence: Synthetic oligonucleotide
  Target: ATXN1; (+) strand; PAM type: YTN; PAM sequence: CTT
tctccccagacccaagattc

SEQ ID NO: 309528 - DNA, 20 bp, Artificial Sequence
  Description of Artificial Sequence: Synthetic oligonucleotide
  Target: ATXN1; (+) strand; PAM type: YTN; PAM sequence: TTT
ctccccagacccaagattca

SEQ ID NO: 309529 - DNA, 20 bp, Artificial Sequence
  Description of Artificial Sequence: Synthetic oligonucleotide
  Target: ATXN1; (+) strand; PAM type: YTN; PAM sequence: TTC
tccccagacccaagattcac

SEQ ID NO: 309530 - DNA, 20 bp, Artificial Sequence
  Description of Artificial Sequence: Synthetic oligonucleotide
  Target: ATXN1; (+) strand; PAM type: YTN; PAM sequence: CTC
cccagacccaagattcacca

SEQ ID NO: 309531 - DNA, 20 bp, Artificial Sequence
  Description of Artificial Sequence: Synthetic oligonucleotide
  Target: ATXN1; (+) strand; PAM type: YTN; PAM sequence: TTC
accaattctatatctcttta

SEQ ID NO: 309532 - DNA, 20 bp, Artificial Sequence
  Description of Artificial Sequence: Synthetic oligonucleotide
  Target: ATXN1; (+) strand; PAM type: YTN; PAM sequence: TTC
tatatctctttattttctat

SEQ ID NO: 309533 - DNA, 20 bp, Artificial Sequence
  Description of Artificial Sequence: Synthetic oligonucleotide
  Target: ATXN1; (+) strand; PAM type: YTN; PAM sequence: CTA
tatctctttattttctataa

SEQ ID NO: 309534 - DNA, 20 bp, Artificial Sequence
  Description of Artificial Sequence: Synthetic oligonucleotide
  Target: ATXN1; (+) strand; PAM type: YTN; PAM sequence: CTC
tttattttctataaagtata

SEQ ID NO: 309535 - DNA, 20 bp, Artificial Sequence
  Description of Artificial Sequence: Synthetic oligonucleotide
  Target: ATXN1; (+) strand; PAM type: YTN; PAM sequence: CTT
tattttctataaagtataaa

SEQ ID NO: 309536 - DNA, 20 bp, Artificial Sequence
  Description of Artificial Sequence: Synthetic oligonucleotide
  Target: ATXN1; (+) strand; PAM type: YTN; PAM sequence: TTT
attttctataaagtataaat

SEQ ID NO: 309537 - DNA, 20 bp, Artificial Sequence
  Description of Artificial Sequence: Synthetic oligonucleotide
  Target: ATXN1; (+) strand; PAM type: YTN; PAM sequence: TTA
ttttctataaagtataaatg

SEQ ID NO: 309538 - DNA, 20 bp, Artificial Sequence
  Description of Artificial Sequence: Synthetic oligonucleotide
  Target: ATXN1; (+) strand; PAM type: YTN; PAM sequence: TTT
tctataaagtataaatggga

SEQ ID NO: 309539 - DNA, 20 bp, Artificial Sequence
  Description of Artificial Sequence: Synthetic oligonucleotide
  Target: ATXN1; (+) strand; PAM type: YTN; PAM sequence: TTT
ctataaagtataaatgggaa

SEQ ID NO: 309540 - DNA, 20 bp, Artificial Sequence
  Description of Artificial Sequence: Synthetic oligonucleotide
  Target: ATXN1; (+) strand; PAM type: YTN; PAM sequence: TTC
tataaagtataaatgggaag

SEQ ID NO: 309541 - DNA, 20 bp, Artificial Sequence
  Description of Artificial Sequence: Synthetic oligonucleotide
  Target: ATXN1; (+) strand; PAM type: YTN; PAM sequence: CTA
taaagtataaatgggaagcc

SEQ ID NO: 309542 - DNA, 20 bp, Artificial Sequence
  Description of Artificial Sequence: Synthetic oligonucleotide
  Target: ATXN1; (+) strand; PAM type: YTN; PAM sequence: TTG
ttcaaagagctgtgtctagt

SEQ ID NO: 309543 - DNA, 20 bp, Artificial Sequence
  Description of Artificial Sequence: Synthetic oligonucleotide
  Target: ATXN1; (+) strand; PAM type: YTN; PAM sequence: TTC
aaagagctgtgtctagtagc

SEQ ID NO: 309544 - DNA, 20 bp, Artificial Sequence
  Description of Artificial Sequence: Synthetic oligonucleotide
  Target: ATXN1; (+) strand; PAM type: YTN; PAM sequence: CTG
tgtctagtagctaggtatat

SEQ ID NO: 309545 - DNA, 20 bp, Artificial Sequence
  Description of Artificial Sequence: Synthetic oligonucleotide
  Target: ATXN1; (+) strand; PAM type: YTN; PAM sequence: CTA
gtagctaggtatatacagta

SEQ ID NO: 309546 - DNA, 20 bp, Artificial Sequence
  Description of Artificial Sequence: Synthetic oligonucleotide
  Target: ATXN1; (+) strand; PAM type: YTN; PAM sequence: CTA
ggtatatacagtatacacgc

SEQ ID NO: 309547 - DNA, 20 bp, Artificial Sequence
  Description of Artificial Sequence: Synthetic oligonucleotide
  Target: ATXN1; (+) strand; PAM type: YTN; PAM sequence: CTC
acattttaaagagtctgcag

SEQ ID NO: 309548 - DNA, 20 bp, Artificial Sequence
  Description of Artificial Sequence: Synthetic oligonucleotide
  Target: ATXN1; (+) strand; PAM type: YTN; PAM sequence: TTT
taaagagtctgcagaaagcc

SEQ ID NO: 309549 - DNA, 20 bp, Artificial Sequence
  Description of Artificial Sequence: Synthetic oligonucleotide
  Target: ATXN1; (+) strand; PAM type: YTN; PAM sequence: TTT
aaagagtctgcagaaagcct

SEQ ID NO: 309550 - DNA, 20 bp, Artificial Sequence
  Description of Artificial Sequence: Synthetic oligonucleotide
  Target: ATXN1; (+) strand; PAM type: YTN; PAM sequence: TTA
aagagtctgcagaaagcctc

SEQ ID NO: 309551 - DNA, 20 bp, Artificial Sequence
  Description of Artificial Sequence: Synthetic oligonucleotide
  Target: ATXN1; (+) strand; PAM type: YTN; PAM sequence: CTG
cagaaagcctccagggaatc

SEQ ID NO: 309552 - DNA, 20 bp, Artificial Sequence
  Description of Artificial Sequence: Synthetic oligonucleotide
  Target: ATXN1; (+) strand; PAM type: YTN; PAM sequence: CTC
cagggaatcctctaaagtta

SEQ ID NO: 309553 - DNA, 20 bp, Artificial Sequence
  Description of Artificial Sequence: Synthetic oligonucleotide
  Target: ATXN1; (+) strand; PAM type: YTN; PAM sequence: CTC
taaagttacaaaacacaccc

SEQ ID NO: 309554 - DNA, 20 bp, Artificial Sequence
  Description of Artificial Sequence: Synthetic oligonucleotide
  Target: ATXN1; (+) strand; PAM type: YTN; PAM sequence: CTA
aagttacaaaacacacccaa

SEQ ID NO: 309555 - DNA, 20 bp, Artificial Sequence
  Description of Artificial Sequence: Synthetic oligonucleotide
  Target: ATXN1; (+) strand; PAM type: YTN; PAM sequence: TTA
caaaacacacccaaattaat

SEQ ID NO: 309556 - DNA, 20 bp, Artificial Sequence
  Description of Artificial Sequence: Synthetic oligonucleotide
  Target: ATXN1; (+) strand; PAM type: YTN; PAM sequence: TTA
atgtggtttatcaaagtaca

SEQ ID NO: 309557 - DNA, 20 bp, Artificial Sequence
  Description of Artificial Sequence: Synthetic oligonucleotide
  Target: ATXN1; (+) strand; PAM type: YTN; PAM sequence: TTT
atcaaagtacagtaaatgaa

SEQ ID NO: 309558 - DNA, 20 bp, Artificial Sequence
  Description of Artificial Sequence: Synthetic oligonucleotide
  Target: ATXN1; (+) strand; PAM type: YTN; PAM sequence: TTA
tcaaagtacagtaaatgaat

SEQ ID NO: 309559 - DNA, 20 bp, Artificial Sequence
  Description of Artificial Sequence: Synthetic oligonucleotide
  Target: ATXN1; (+) strand; PAM type: YTN; PAM sequence: TTG
ccacaaatgaacaattgcta

SEQ ID NO: 309560 - DNA, 20 bp, Artificial Sequence
  Description of Artificial Sequence: Synthetic oligonucleotide
  Target: ATXN1; (+) strand; PAM type: YTN; PAM sequence: TTG
ctacagagtcaagtagatgg

SEQ ID NO: 309561 - DNA, 20 bp, Artificial Sequence
  Description of Artificial Sequence: Synthetic oligonucleotide
  Target: ATXN1; (+) strand; PAM type: YTN; PAM sequence: CTA
cagagtcaagtagatggcac

SEQ ID NO: 309562 - DNA, 20 bp, Artificial Sequence
  Description of Artificial Sequence: Synthetic oligonucleotide
  Target: ATXN1; (+) strand; PAM type: YTN; PAM sequence: TTG
tgatttacgcatatcatgtg

SEQ ID NO: 309563 - DNA, 20 bp, Artificial Sequence
  Description of Artificial Sequence: Synthetic oligonucleotide
  Target: ATXN1; (+) strand; PAM type: YTN; PAM sequence: TTT
acgcatatcatgtgagatga

SEQ ID NO: 309564 - DNA, 20 bp, Artificial Sequence
  Description of Artificial Sequence: Synthetic oligonucleotide
  Target: ATXN1; (+) strand; PAM type: YTN; PAM sequence: TTA
cgcatatcatgtgagatgaa

SEQ ID NO: 309565 - DNA, 20 bp, Artificial Sequence
  Description of Artificial Sequence: Synthetic oligonucleotide
  Target: ATXN1; (+) strand; PAM type: YTN; PAM sequence: CTG
gaattgttgttaaaacgtac

SEQ ID NO: 309566 - DNA, 20 bp, Artificial Sequence
  Description of Artificial Sequence: Synthetic oligonucleotide
  Target: ATXN1; (+) strand; PAM type: YTN; PAM sequence: TTG
ttgttaaaacgtacagggct

SEQ ID NO: 309567 - DNA, 20 bp, Artificial Sequence
  Description of Artificial Sequence: Synthetic oligonucleotide
  Target: ATXN1; (+) strand; PAM type: YTN; PAM sequence: TTG
ttaaaacgtacagggcttca

SEQ ID NO: 309568 - DNA, 20 bp, Artificial Sequence
  Description of Artificial Sequence: Synthetic oligonucleotide
  Target: ATXN1; (+) strand; PAM type: YTN; PAM sequence: TTA
aaacgtacagggcttcactg

SEQ ID NO: 309569 - DNA, 20 bp, Artificial Sequence
  Description of Artificial Sequence: Synthetic oligonucleotide
  Target: ATXN1; (+) strand; PAM type: YTN; PAM sequence: CTT
cactgaaaatcttaataaaa

SEQ ID NO: 309570 - DNA, 20 bp, Artificial Sequence
  Description of Artificial Sequence: Synthetic oligonucleotide
  Target: ATXN1; (+) strand; PAM type: YTN; PAM sequence: TTC
actgaaaatcttaataaaac

SEQ ID NO: 309571 - DNA, 20 bp, Artificial Sequence
  Description of Artificial Sequence: Synthetic oligonucleotide
  Target: ATXN1; (+) strand; PAM type: YTN; PAM sequence: CTG
aaaatcttaataaaactgtt

SEQ ID NO: 309572 - DNA, 20 bp, Artificial Sequence
  Description of Artificial Sequence: Synthetic oligonucleotide
  Target: ATXN1; (+) strand; PAM type: YTN; PAM sequence: CTT
aataaaactgtttagaggaa

SEQ ID NO: 309573 - DNA, 20 bp, Artificial Sequence
  Description of Artificial Sequence: Synthetic oligonucleotide
  Target: ATXN1; (+) strand; PAM type: YTN; PAM sequence: TTA
ataaaactgtttagaggaaa

SEQ ID NO: 309574 - DNA, 20 bp, Artificial Sequence
  Description of Artificial Sequence: Synthetic oligonucleotide
  Target: ATXN1; (+) strand; PAM type: YTN; PAM sequence: CTG
tttagaggaaaatagaagga

SEQ ID NO: 309575 - DNA, 20 bp, Artificial Sequence
  Description of Artificial Sequence: Synthetic oligonucleotide
  Target: ATXN1; (+) strand; PAM type: YTN; PAM sequence: TTT
agaggaaaatagaaggatca

SEQ ID NO: 309576 - DNA, 20 bp, Artificial Sequence
  Description of Artificial Sequence: Synthetic oligonucleotide
  Target: ATXN1; (+) strand; PAM type: YTN; PAM sequence: TTA
gaggaaaatagaaggatcat

SEQ ID NO: 309577 - DNA, 20 bp, Artificial Sequence
  Description of Artificial Sequence: Synthetic oligonucleotide
  Target: ATXN1; (+) strand; PAM type: YTN; PAM sequence: TTT
gtttaacgagataccgcata

SEQ ID NO: 309578 - DNA, 20 bp, Artificial Sequence
  Description of Artificial Sequence: Synthetic oligonucleotide
  Target: ATXN1; (+) strand; PAM type: YTN; PAM sequence: TTG
tttaacgagataccgcatac

SEQ ID NO: 309579 - DNA, 20 bp, Artificial Sequence
  Description of Artificial Sequence: Synthetic oligonucleotide
  Target: ATXN1; (+) strand; PAM type: YTN; PAM sequence: TTT
aacgagataccgcatacgct

SEQ ID NO: 309580 - DNA, 20 bp, Artificial Sequence
  Description of Artificial Sequence: Synthetic oligonucleotide
  Target: ATXN1; (+) strand; PAM type: YTN; PAM sequence: TTA
acgagataccgcatacgctg

SEQ ID NO: 309581 - DNA, 20 bp, Artificial Sequence
  Description of Artificial Sequence: Synthetic oligonucleotide
  Target: ATXN1; (+) strand; PAM type: YTN; PAM sequence: CTG
aatttcaaacgcagcattca

SEQ ID NO: 309582 - DNA, 20 bp, Artificial Sequence
  Description of Artificial Sequence: Synthetic oligonucleotide
  Target: ATXN1; (+) strand; PAM type: YTN; PAM sequence: TTT
caaacgcagcattcattttt

SEQ ID NO: 309583 - DNA, 20 bp, Artificial Sequence
  Description of Artificial Sequence: Synthetic oligonucleotide
  Target: ATXN1; (+) strand; PAM type: YTN; PAM sequence: TTC
aaacgcagcattcattttta

SEQ ID NO: 309584 - DNA, 20 bp, Artificial Sequence
  Description of Artificial Sequence: Synthetic oligonucleotide
  Target: ATXN1; (+) strand; PAM type: YTN; PAM sequence: TTC
atttttatacacacacacat

SEQ ID NO: 309585 - DNA, 20 bp, Artificial Sequence
  Description of Artificial Sequence: Synthetic oligonucleotide
  Target: ATXN1; (+) strand; PAM type: YTN; PAM sequence: TTT
ttatacacacacacattaga

SEQ ID NO: 309586 - DNA, 20 bp, Artificial Sequence
  Description of Artificial Sequence: Synthetic oligonucleotide
  Target: ATXN1; (+) strand; PAM type: YTN; PAM sequence: TTT
tatacacacacacattagat

SEQ ID NO: 309587 - DNA, 20 bp, Artificial Sequence
  Description of Artificial Sequence: Synthetic oligonucleotide
  Target: ATXN1; (+) strand; PAM type: YTN; PAM sequence: TTT
atacacacacacattagatt

SEQ ID NO: 309588 - DNA, 20 bp, Artificial Sequence
  Description of Artificial Sequence: Synthetic oligonucleotide
  Target: ATXN1; (+) strand; PAM type: YTN; PAM sequence: TTA
tacacacacacattagattt

SEQ ID NO: 309589 - DNA, 20 bp, Artificial Sequence
  Description of Artificial Sequence: Synthetic oligonucleotide
  Target: ATXN1; (+) strand; PAM type: YTN; PAM sequence: TTA
gatttagctaaaattagctc

SEQ ID NO: 309590 - DNA, 20 bp, Artificial Sequence
  Description of Artificial Sequence: Synthetic oligonucleotide
  Target: ATXN1; (+) strand; PAM type: YTN; PAM sequence: TTT
agctaaaattagctcaagtt

SEQ ID NO: 309591 - DNA, 20 bp, Artificial Sequence
  Description of Artificial Sequence: Synthetic oligonucleotide
  Target: ATXN1; (+) strand; PAM type: YTN; PAM sequence: TTA
gctaaaattagctcaagttc

SEQ ID NO: 309592 - DNA, 20 bp, Artificial Sequence
  Description of Artificial Sequence: Synthetic oligonucleotide
  Target: ATXN1; (+) strand; PAM type: YTN; PAM sequence: CTA
aaattagctcaagttcctat

SEQ ID NO: 309593 - DNA, 20 bp, Artificial Sequence
  Description of Artificial Sequence: Synthetic oligonucleotide
  Target: ATXN1; (+) strand; PAM type: YTN; PAM sequence: TTA
gctcaagttcctattttttt

SEQ ID NO: 309594 - DNA, 20 bp, Artificial Sequence
  Description of Artificial Sequence: Synthetic oligonucleotide
  Target: ATXN1; (+) strand; PAM type: YTN; PAM sequence: CTC
aagttcctatttttttaaag

SEQ ID NO: 309595 - DNA, 20 bp, Artificial Sequence
  Description of Artificial Sequence: Synthetic oligonucleotide
  Target: ATXN1; (+) strand; PAM type: YTN; PAM sequence: TTC
ctatttttttaaaggtctta

SEQ ID NO: 309596 - DNA, 20 bp, Artificial Sequence
  Description of Artificial Sequence: Synthetic oligonucleotide
  Target: ATXN1; (+) strand; PAM type: YTN; PAM sequence: CTA
tttttttaaaggtcttaaag

SEQ ID NO: 309597 - DNA, 20 bp, Artificial Sequence
  Description of Artificial Sequence: Synthetic oligonucleotide
  Target: ATXN1; (+) strand; PAM type: YTN; PAM sequence: TTT
ttttaaaggtcttaaaggaa

SEQ ID NO: 309598 - DNA, 20 bp, Artificial Sequence
  Description of Artificial Sequence: Synthetic oligonucleotide
  Target: ATXN1; (+) strand; PAM type: YTN; PAM sequence: TTT
tttaaaggtcttaaaggaag

SEQ ID NO: 309599 - DNA, 20 bp, Artificial Sequence
  Description of Artificial Sequence: Synthetic oligonucleotide
  Target: ATXN1; (+) strand; PAM type: YTN; PAM sequence: TTT
ttaaaggtcttaaaggaaga

SEQ ID NO: 309600 - DNA, 20 bp, Artificial Sequence
  Description of Artificial Sequence: Synthetic oligonucleotide
  Target: ATXN1; (+) strand; PAM type: YTN; PAM sequence: TTT
taaaggtcttaaaggaagag

SEQ ID NO: 309601 - DNA, 20 bp, Artificial Sequence
  Description of Artificial Sequence: Synthetic oligonucleotide
  Target: ATXN1; (+) strand; PAM type: YTN; PAM sequence: TTT
aaaggtcttaaaggaagaga

SEQ ID NO: 309602 - DNA, 20 bp, Artificial Sequence
  Description of Artificial Sequence: Synthetic oligonucleotide
  Target: ATXN1; (+) strand; PAM type: YTN; PAM sequence: TTA
aaggtcttaaaggaagagag

SEQ ID NO: 309603 - DNA, 20 bp, Artificial Sequence
  Description of Artificial Sequence: Synthetic oligonucleotide
  Target: ATXN1; (+) strand; PAM type: YTN; PAM sequence: CTT
aaaggaagagaggttttgac

SEQ ID NO: 309604 - DNA, 20 bp, Artificial Sequence
  Description of Artificial Sequence: Synthetic oligonucleotide
  Target: ATXN1; (+) strand; PAM type: YTN; PAM sequence: TTA
aaggaagagaggttttgaca

SEQ ID NO: 309605 - DNA, 20 bp, Artificial Sequence
  Description of Artificial Sequence: Synthetic oligonucleotide
  Target: ATXN1; (+) strand; PAM type: YTN; PAM sequence: TTT
tgacaagatttcattgaact

SEQ ID NO: 309606 - DNA, 20 bp, Artificial Sequence
  Description of Artificial Sequence: Synthetic oligonucleotide
  Target: ATXN1; (+) strand; PAM type: YTN; PAM sequence: TTT
gacaagatttcattgaactg

SEQ ID NO: 309607 - DNA, 20 bp, Artificial Sequence
  Description of Artificial Sequence: Synthetic oligonucleotide
  Target: ATXN1; (+) strand; PAM type: YTN; PAM sequence: TTG
acaagatttcattgaactgt

SEQ ID NO: 309608 - DNA, 20 bp, Artificial Sequence
  Description of Artificial Sequence: Synthetic oligonucleotide
  Target: ATXN1; (+) strand; PAM type: YTN; PAM sequence: TTT
cattgaactgtagttcagca

SEQ ID NO: 309609 - DNA, 20 bp, Artificial Sequence
  Description of Artificial Sequence: Synthetic oligonucleotide
  Target: ATXN1; (+) strand; PAM type: YTN; PAM sequence: TTC
attgaactgtagttcagcac

SEQ ID NO: 309610 - DNA, 20 bp, Artificial Sequence
  Description of Artificial Sequence: Synthetic oligonucleotide
  Target: ATXN1; (+) strand; PAM type: YTN; PAM sequence: TTG
aactgtagttcagcactgag

SEQ ID NO: 309611 - DNA, 20 bp, Artificial Sequence
  Description of Artificial Sequence: Synthetic oligonucleotide
  Target: ATXN1; (+) strand; PAM type: YTN; PAM sequence: CTG
tagttcagcactgagtttcc

SEQ ID NO: 309612 - DNA, 20 bp, Artificial Sequence
  Description of Artificial Sequence: Synthetic oligonucleotide
  Target: ATXN1; (+) strand; PAM type: YTN; PAM sequence: TTC
agcactgagtttccaaggtg

SEQ ID NO: 309613 - DNA, 20 bp, Artificial Sequence
  Description of Artificial Sequence: Synthetic oligonucleotide
  Target: ATXN1; (+) strand; PAM type: YTN; PAM sequence: CTG
agtttccaaggtgcctgagc

SEQ ID NO: 309614 - DNA, 20 bp, Artificial Sequence
  Description of Artificial Sequence: Synthetic oligonucleotide
  Target: ATXN1; (+) strand; PAM type: YTN; PAM sequence: TTT
ccaaggtgcctgagctgcag

SEQ ID NO: 309615 - DNA, 20 bp, Artificial Sequence
  Description of Artificial Sequence: Synthetic oligonucleotide
  Target: ATXN1; (+) strand; PAM type: YTN; PAM sequence: TTC
caaggtgcctgagctgcaga

SEQ ID NO: 309616 - DNA, 20 bp, Artificial Sequence
  Description of Artificial Sequence: Synthetic oligonucleotide
  Target: ATXN1; (+) strand; PAM type: YTN; PAM sequence: CTG
agctgcagaagagtccttat

SEQ ID NO: 309617 - DNA, 20 bp, Artificial Sequence
  Description of Artificial Sequence: Synthetic oligonucleotide
  Target: ATXN1; (+) strand; PAM type: YTN; PAM sequence: CTG
cagaagagtccttatggccc

SEQ ID NO: 309618 - DNA, 20 bp, Artificial Sequence
  Description of Artificial Sequence: Synthetic oligonucleotide
  Target: ATXN1; (+) strand; PAM type: YTN; PAM sequence: CTT
atggcccacgcatacatcac

SEQ ID NO: 309619 - DNA, 20 bp, Artificial Sequence
  Description of Artificial Sequence: Synthetic oligonucleotide
  Target: ATXN1; (+) strand; PAM type: YTN; PAM sequence: TTA
tggcccacgcatacatcacc

SEQ ID NO: 309620 - DNA, 20 bp, Artificial Sequence
  Description of Artificial Sequence: Synthetic oligonucleotide
  Target: ATXN1; (+) strand; PAM type: YTN; PAM sequence: CTC
ctccagccacccagcctcct

SEQ ID NO: 309621 - DNA, 20 bp, Artificial Sequence
  Description of Artificial Sequence: Synthetic oligonucleotide
  Target: ATXN1; (+) strand; PAM type: YTN; PAM sequence: CTC
cagccacccagcctccttca

SEQ ID NO: 309622 - DNA, 20 bp, Artificial Sequence
  Description of Artificial Sequence: Synthetic oligonucleotide
  Target: ATXN1; (+) strand; PAM type: YTN; PAM sequence: CTC
cttcaccccagatcatgaaa

SEQ ID NO: 309623 - DNA, 20 bp, Artificial Sequence
  Description of Artificial Sequence: Synthetic oligonucleotide
  Target: ATXN1; (+) strand; PAM type: YTN; PAM sequence: CTT
caccccagatcatgaaaaga

SEQ ID NO: 309624 - DNA, 20 bp, Artificial Sequence
  Description of Artificial Sequence: Synthetic oligonucleotide
  Target: ATXN1; (+) strand; PAM type: YTN; PAM sequence: TTC
accccagatcatgaaaagaa

SEQ ID NO: 309625 - DNA, 20 bp, Artificial Sequence
  Description of Artificial Sequence: Synthetic oligonucleotide
  Target: ATXN1; (+) strand; PAM type: YTN; PAM sequence: TTG
aagctactctccgctgcctc

SEQ ID NO: 309626 - DNA, 20 bp, Artificial Sequence
  Description of Artificial Sequence: Synthetic oligonucleotide
  Target: ATXN1; (+) strand; PAM type: YTN; PAM sequence: CTA
ctctccgctgcctcttacct

SEQ ID NO: 309627 - DNA, 20 bp, Artificial Sequence
  Description of Artificial Sequence: Synthetic oligonucleotide
  Target: ATXN1; (+) strand; PAM type: YTN; PAM sequence: CTC
tccgctgcctcttaccttct

SEQ ID NO: 309628 - DNA, 20 bp, Artificial Sequence
  Description of Artificial Sequence: Synthetic oligonucleotide
  Target: ATXN1; (+) strand; PAM type: YTN; PAM sequence: CTC
cgctgcctcttaccttctct

SEQ ID NO: 309629 - DNA, 20 bp, Artificial Sequence
  Description of Artificial Sequence: Synthetic oligonucleotide
  Target: ATXN1; (+) strand; PAM type: YTN; PAM sequence: CTG
cctcttaccttctctctaca

SEQ ID NO: 309630 - DNA, 20 bp, Artificial Sequence
  Description of Artificial Sequence: Synthetic oligonucleotide
  Target: ATXN1; (+) strand; PAM type: YTN; PAM sequence: CTC
ttaccttctctctacacatt

SEQ ID NO: 309631 - DNA, 20 bp, Artificial Sequence
  Description of Artificial Sequence: Synthetic oligonucleotide
  Target: ATXN1; (+) strand; PAM type: YTN; PAM sequence: CTT
accttctctctacacattct

SEQ ID NO: 309632 - DNA, 20 bp, Artificial Sequence
  Description of Artificial Sequence: Synthetic oligonucleotide
  Target: ATXN1; (+) strand; PAM type: YTN; PAM sequence: TTA
ccttctctctacacattcta

SEQ ID NO: 309633 - DNA, 20 bp, Artificial Sequence
  Description of Artificial Sequence: Synthetic oligonucleotide
  Target: ATXN1; (+) strand; PAM type: YTN; PAM sequence: CTT
ctctctacacattctacacc

SEQ ID NO: 309634 - DNA, 20 bp, Artificial Sequence
  Description of Artificial Sequence: Synthetic oligonucleotide
  Target: ATXN1; (+) strand; PAM type: YTN; PAM sequence: TTC
tctctacacattctacacca

SEQ ID NO: 309635 - DNA, 20 bp, Artificial Sequence
  Description of Artificial Sequence: Synthetic oligonucleotide
  Target: ATXN1; (+) strand; PAM type: YTN; PAM sequence: CTC
tctacacattctacaccagc

SEQ ID NO: 309636 - DNA, 20 bp, Artificial Sequence
  Description of Artificial Sequence: Synthetic oligonucleotide
  Target: ATXN1; (+) strand; PAM type: YTN; PAM sequence: CTC
tacacattctacaccagctg

SEQ ID NO: 309637 - DNA, 20 bp, Artificial Sequence
  Description of Artificial Sequence: Synthetic oligonucleotide
  Target: ATXN1; (+) strand; PAM type: YTN; PAM sequence: CTA
cacattctacaccagctgac

SEQ ID NO: 309638 - DNA, 20 bp, Artificial Sequence
  Description of Artificial Sequence: Synthetic oligonucleotide
  Target: ATXN1; (+) strand; PAM type: YTN; PAM sequence: TTC
tacaccagctgacgtcatcc

SEQ ID NO: 309639 - DNA, 20 bp, Artificial Sequence
  Description of Artificial Sequence: Synthetic oligonucleotide
  Target: ATXN1; (+) strand; PAM type: YTN; PAM sequence: CTA
caccagctgacgtcatccct

SEQ ID NO: 309640 - DNA, 20 bp, Artificial Sequence
  Description of Artificial Sequence: Synthetic oligonucleotide
  Target: ATXN1; (+) strand; PAM type: YTN; PAM sequence: CTG
acgtcatccctgaattcagt

SEQ ID NO: 309641 - DNA, 20 bp, Artificial Sequence
  Description of Artificial Sequence: Synthetic oligonucleotide
  Target: ATXN1; (+) strand; PAM type: YTN; PAM sequence: CTG
aattcagtcatccccctcct

SEQ ID NO: 309642 - DNA, 20 bp, Artificial Sequence
  Description of Artificial Sequence: Synthetic oligonucleotide
  Target: ATXN1; (+) strand; PAM type: YTN; PAM sequence: TTC
agtcatccccctcctgggtg

SEQ ID NO: 309643 - DNA, 20 bp, Artificial Sequence
  Description of Artificial Sequence: Synthetic oligonucleotide
  Target: ATXN1; (+) strand; PAM type: YTN; PAM sequence: CTC
ctgggtgtcaaactttttgc

SEQ ID NO: 309644 - DNA, 20 bp, Artificial Sequence
  Description of Artificial Sequence: Synthetic oligonucleotide
  Target: ATXN1; (+) strand; PAM type: YTN; PAM sequence: CTG
ggtgtcaaactttttgccag

SEQ ID NO: 309645 - DNA, 20 bp, Artificial Sequence
  Description of Artificial Sequence: Synthetic oligonucleotide
  Target: ATXN1; (+) strand; PAM type: YTN; PAM sequence: CTT
tttgccaggcccaagaaccc

SEQ ID NO: 309646 - DNA, 20 bp, Artificial Sequence
  Description of Artificial Sequence: Synthetic oligonucleotide
  Target: ATXN1; (+) strand; PAM type: YTN; PAM sequence: TTT
ttgccaggcccaagaaccca

SEQ ID NO: 309647 - DNA, 20 bp, Artificial Sequence
  Description of Artificial Sequence: Synthetic oligonucleotide
  Target: ATXN1; (+) strand; PAM type: YTN; PAM sequence: TTT
tgccaggcccaagaacccaa

SEQ ID NO: 309648 - DNA, 20 bp, Artificial Sequence
  Description of Artificial Sequence: Synthetic oligonucleotide
  Target: ATXN1; (+) strand; PAM type: YTN; PAM sequence: TTT
gccaggcccaagaacccaat

SEQ ID NO: 309649 - DNA, 20 bp, Artificial Sequence
  Description of Artificial Sequence: Synthetic oligonucleotide
  Target: ATXN1; (+) strand; PAM type: YTN; PAM sequence: TTG
ccaggcccaagaacccaatt

SEQ ID NO: 309650 - DNA, 20 bp, Artificial Sequence
  Description of Artificial Sequence: Synthetic oligonucleotide
  Target: ATXN1; (+) strand; PAM type: YTN; PAM sequence: TTT
caaagatcacttttatgcca

SEQ ID NO: 309651 - DNA, 20 bp, Artificial Sequence
  Description of Artificial Sequence: Synthetic oligonucleotide
  Target: ATXN1; (+) strand; PAM type: YTN; PAM sequence: TTC
aaagatcacttttatgccaa

SEQ ID NO: 309652 - DNA, 20 bp, Artificial Sequence
  Description of Artificial Sequence: Synthetic oligonucleotide
  Target: ATXN1; (+) strand; PAM type: YTN; PAM sequence: CTT
ttatgccaaggactcctcca

SEQ ID NO: 309653 - DNA, 20 bp, Artificial Sequence
  Description of Artificial Sequence: Synthetic oligonucleotide
  Target: ATXN1; (+) strand; PAM type: YTN; PAM sequence: TTT
tatgccaaggactcctccaa

SEQ ID NO: 309654 - DNA, 20 bp, Artificial Sequence
  Description of Artificial Sequence: Synthetic oligonucleotide
  Target: ATXN1; (+) strand; PAM type: YTN; PAM sequence: TTT
atgccaaggactcctccaaa

SEQ ID NO: 309655 - DNA, 20 bp, Artificial Sequence
  Description of Artificial Sequence: Synthetic oligonucleotide
  Target: ATXN1; (+) strand; PAM type: YTN; PAM sequence: TTA
tgccaaggactcctccaaat

SEQ ID NO: 309656 - DNA, 20 bp, Artificial Sequence
  Description of Artificial Sequence: Synthetic oligonucleotide
  Target: ATXN1; (+) strand; PAM type: YTN; PAM sequence: CTC
ctccaaatttatcttcagac

SEQ ID NO: 309657 - DNA, 20 bp, Artificial Sequence
  Description of Artificial Sequence: Synthetic oligonucleotide
  Target: ATXN1; (+) strand; PAM type: YTN; PAM sequence: CTC
caaatttatcttcagacttg

SEQ ID NO: 309658 - DNA, 20 bp, Artificial Sequence
  Description of Artificial Sequence: Synthetic oligonucleotide
  Target: ATXN1; (+) strand; PAM type: YTN; PAM sequence: TTT
atcttcagacttgacctctc

SEQ ID NO: 309659 - DNA, 20 bp, Artificial Sequence
  Description of Artificial Sequence: Synthetic oligonucleotide
  Target: ATXN1; (+) strand; PAM type: YTN; PAM sequence: TTA
tcttcagacttgacctctcg

SEQ ID NO: 309660 - DNA, 20 bp, Artificial Sequence
  Description of Artificial Sequence: Synthetic oligonucleotide
  Target: ATXN1; (+) strand; PAM type: YTN; PAM sequence: CTT
cagacttgacctctcggcag

SEQ ID NO: 309661 - DNA, 20 bp, Artificial Sequence
  Description of Artificial Sequence: Synthetic oligonucleotide
  Target: ATXN1; (+) strand; PAM type: YTN; PAM sequence: TTC
agacttgacctctcggcagt

SEQ ID NO: 309662 - DNA, 20 bp, Artificial Sequence
  Description of Artificial Sequence: Synthetic oligonucleotide
  Target: ATXN1; (+) strand; PAM type: YTN; PAM sequence: CTT
gacctctcggcagttttatt

SEQ ID NO: 309663 - DNA, 20 bp, Artificial Sequence
  Description of Artificial Sequence: Synthetic oligonucleotide
  Target: ATXN1; (+) strand; PAM type: YTN; PAM sequence: TTG
acctctcggcagttttattc

SEQ ID NO: 309664 - DNA, 20 bp, Artificial Sequence
  Description of Artificial Sequence: Synthetic oligonucleotide
  Target: ATXN1; (+) strand; PAM type: YTN; PAM sequence: CTC
tcggcagttttattcccata

SEQ ID NO: 309665 - DNA, 20 bp, Artificial Sequence
  Description of Artificial Sequence: Synthetic oligonucleotide
  Target: ATXN1; (+) strand; PAM type: YTN; PAM sequence: CTC
ggcagttttattcccatact

SEQ ID NO: 309666 - DNA, 20 bp, Artificial Sequence
  Description of Artificial Sequence: Synthetic oligonucleotide
  Target: ATXN1; (+) strand; PAM type: YTN; PAM sequence: TTT
tattcccatactctctactg

SEQ ID NO: 309667 - DNA, 20 bp, Artificial Sequence
  Description of Artificial Sequence: Synthetic oligonucleotide
  Target: ATXN1; (+) strand; PAM type: YTN; PAM sequence: TTT
attcccatactctctactgt

SEQ ID NO: 309668 - DNA, 20 bp, Artificial Sequence
  Description of Artificial Sequence: Synthetic oligonucleotide
  Target: ATXN1; (+) strand; PAM type: YTN; PAM sequence: TTA
ttcccatactctctactgtc

SEQ ID NO: 309669 - DNA, 20 bp, Artificial Sequence
  Description of Artificial Sequence: Synthetic oligonucleotide
  Target: ATXN1; (+) strand; PAM type: YTN; PAM sequence: TTC
ccatactctctactgtctgc

SEQ ID NO: 309670 - DNA, 20 bp, Artificial Sequence
  Description of Artificial Sequence: Synthetic oligonucleotide
  Target: ATXN1; (+) strand; PAM type: YTN; PAM sequence: CTC
tctactgtctgctcgaatcc

SEQ ID NO: 309671 - DNA, 20 bp, Artificial Sequence
  Description of Artificial Sequence: Synthetic oligonucleotide
  Target: ATXN1; (+) strand; PAM type: YTN; PAM sequence: CTC
tactgtctgctcgaatccag

SEQ ID NO: 309672 - DNA, 20 bp, Artificial Sequence
  Description of Artificial Sequence: Synthetic oligonucleotide
  Target: ATXN1; (+) strand; PAM type: YTN; PAM sequence: CTA
ctgtctgctcgaatccagaa

SEQ ID NO: 309673 - DNA, 20 bp, Artificial Sequence
  Description of Artificial Sequence: Synthetic oligonucleotide
  Target: ATXN1; (+) strand; PAM type: YTN; PAM sequence: CTG
tctgctcgaatccagaaatt

SEQ ID NO: 309674 - DNA, 20 bp, Artificial Sequence
  Description of Artificial Sequence: Synthetic oligonucleotide
  Target: ATXN1; (+) strand; PAM type: YTN; PAM sequence: CTG
ctcgaatccagaaattcaga

SEQ ID NO: 309675 - DNA, 20 bp, Artificial Sequence
  Description of Artificial Sequence: Synthetic oligonucleotide
  Target: ATXN1; (+) strand; PAM type: YTN; PAM sequence: CTC
gaatccagaaattcagatgt

SEQ ID NO: 309676 - DNA, 20 bp, Artificial Sequence
  Description of Artificial Sequence: Synthetic oligonucleotide
  Target: ATXN1; (+) strand; PAM type: YTN; PAM sequence: TTC
agatgtccaccagcacctag

SEQ ID NO: 309677 - DNA, 20 bp, Artificial Sequence
  Description of Artificial Sequence: Synthetic oligonucleotide
  Target: ATXN1; (+) strand; PAM type: YTN; PAM sequence: CTA
ggcttcagtcaaaatgtcct

SEQ ID NO: 309678 - DNA, 20 bp, Artificial Sequence
  Description of Artificial Sequence: Synthetic oligonucleotide
  Target: ATXN1; (+) strand; PAM type: YTN; PAM sequence: CTT
cagtcaaaatgtcctggtca

SEQ ID NO: 309679 - DNA, 20 bp, Artificial Sequence
  Description of Artificial Sequence: Synthetic oligonucleotide
  Target: ATXN1; (+) strand; PAM type: YTN; PAM sequence: TTC
agtcaaaatgtcctggtcag

SEQ ID NO: 309680 - DNA, 20 bp, Artificial Sequence
  Description of Artificial Sequence: Synthetic oligonucleotide
  Target: ATXN1; (+) strand; PAM type: YTN; PAM sequence: CTG
gtcagttacataccgtgcat

SEQ ID NO: 309681 - DNA, 20 bp, Artificial Sequence
  Description of Artificial Sequence: Synthetic oligonucleotide
  Target: ATXN1; (+) strand; PAM type: YTN; PAM sequence: TTA
cataccgtgcattggcttgt

SEQ ID NO: 309682 - DNA, 20 bp, Artificial Sequence
  Description of Artificial Sequence: Synthetic oligonucleotide
  Target: ATXN1; (+) strand; PAM type: YTN; PAM sequence: TTG
gcttgttatgtcccagacac

SEQ ID NO: 309683 - DNA, 20 bp, Artificial Sequence
  Description of Artificial Sequence: Synthetic oligonucleotide
  Target: ATXN1; (+) strand; PAM type: YTN; PAM sequence: CTT
gttatgtcccagacacacac

SEQ ID NO: 309684 - DNA, 20 bp, Artificial Sequence
  Description of Artificial Sequence: Synthetic oligonucleotide
  Target: ATXN1; (+) strand; PAM type: YTN; PAM sequence: TTG
ttatgtcccagacacacaca

SEQ ID NO: 309685 - DNA, 20 bp, Artificial Sequence
  Description of Artificial Sequence: Synthetic oligonucleotide
  Target: ATXN1; (+) strand; PAM type: YTN; PAM sequence: TTA
tgtcccagacacacacatgg

SEQ ID NO: 309686 - DNA, 20 bp, Artificial Sequence
  Description of Artificial Sequence: Synthetic oligonucleotide
  Target: ATXN1; (+) strand; PAM type: YTN; PAM sequence: CTT
cctcatgctccatccatctc

SEQ ID NO: 309687 - DNA, 20 bp, Artificial Sequence
  Description of Artificial Sequence: Synthetic oligonucleotide
  Target: ATXN1; (+) strand; PAM type: YTN; PAM sequence: TTC
ctcatgctccatccatctct

SEQ ID NO: 309688 - DNA, 20 bp, Artificial Sequence
  Description of Artificial Sequence: Synthetic oligonucleotide
  Target: ATXN1; (+) strand; PAM type: YTN; PAM sequence: CTC
atgctccatccatctcttcc

SEQ ID NO: 309689 - DNA, 20 bp, Artificial Sequence
  Description of Artificial Sequence: Synthetic oligonucleotide
  Target: ATXN1; (+) strand; PAM type: YTN; PAM sequence: CTC
catccatctcttcccacaga

SEQ ID NO: 309690 - DNA, 20 bp, Artificial Sequence
  Description of Artificial Sequence: Synthetic oligonucleotide
  Target: ATXN1; (+) strand; PAM type: YTN; PAM sequence: CTC
ttcccacagaaatgcaatct

SEQ ID NO: 309691 - DNA, 20 bp, Artificial Sequence
  Description of Artificial Sequence: Synthetic oligonucleotide
  Target: ATXN1; (+) strand; PAM type: YTN; PAM sequence: CTT
cccacagaaatgcaatctag

SEQ ID NO: 309692 - DNA, 20 bp, Artificial Sequence
  Description of Artificial Sequence: Synthetic oligonucleotide
  Target: ATXN1; (+) strand; PAM type: YTN; PAM sequence: TTC
ccacagaaatgcaatctagt

SEQ ID NO: 309693 - DNA, 20 bp, Artificial Sequence
  Description of Artificial Sequence: Synthetic oligonucleotide
  Target: ATXN1; (+) strand; PAM type: YTN; PAM sequence: CTA
gtcagcagagctcaactcaa

SEQ ID NO: 309694 - DNA, 20 bp, Artificial Sequence
  Description of Artificial Sequence: Synthetic oligonucleotide
  Target: ATXN1; (+) strand; PAM type: YTN; PAM sequence: CTC
aactcaagtgatccctcctc

SEQ ID NO: 309695 - DNA, 20 bp, Artificial Sequence
  Description of Artificial Sequence: Synthetic oligonucleotide
  Target: ATXN1; (+) strand; PAM type: YTN; PAM sequence: CTC
aagtgatccctcctcctcaa

SEQ ID NO: 309696 - DNA, 20 bp, Artificial Sequence
  Description of Artificial Sequence: Synthetic oligonucleotide
  Target: ATXN1; (+) strand; PAM type: YTN; PAM sequence: CTC
ctcctcaaagtctttcctga

SEQ ID NO: 309697 - DNA, 20 bp, Artificial Sequence
  Description of Artificial Sequence: Synthetic oligonucleotide
  Target: ATXN1; (+) strand; PAM type: YTN; PAM sequence: CTC
ctcaaagtctttcctgatca

SEQ ID NO: 309698 - DNA, 20 bp, Artificial Sequence
  Description of Artificial Sequence: Synthetic oligonucleotide
  Target: ATXN1; (+) strand; PAM type: YTN; PAM sequence: CTC
aaagtctttcctgatcactc

SEQ ID NO: 309699 - DNA, 20 bp, Artificial Sequence
  Description of Artificial Sequence: Synthetic oligonucleotide
  Target: ATXN1; (+) strand; PAM type: YTN; PAM sequence: CTT
tcctgatcactcctactcag

SEQ ID NO: 309700 - DNA, 20 bp, Artificial Sequence
  Description of Artificial Sequence: Synthetic oligonucleotide
  Target: ATXN1; (+) strand; PAM type: YTN; PAM sequence: TTT
cctgatcactcctactcagc

SEQ ID NO: 309701 - DNA, 20 bp, Artificial Sequence
  Description of Artificial Sequence: Synthetic oligonucleotide
  Target: ATXN1; (+) strand; PAM type: YTN; PAM sequence: TTC
ctgatcactcctactcagcg

SEQ ID NO: 309702 - DNA, 20 bp, Artificial Sequence
  Description of Artificial Sequence: Synthetic oligonucleotide
  Target: ATXN1; (+) strand; PAM type: YTN; PAM sequence: CTG
atcactcctactcagcgtca

SEQ ID NO: 309703 - DNA, 20 bp, Artificial Sequence
  Description of Artificial Sequence: Synthetic oligonucleotide
  Target: ATXN1; (+) strand; PAM type: YTN; PAM sequence: CTC
ctactcagcgtcactcttct

SEQ ID NO: 309704 - DNA, 20 bp, Artificial Sequence
  Description of Artificial Sequence: Synthetic oligonucleotide
  Target: ATXN1; (+) strand; PAM type: YTN; PAM sequence: CTA
ctcagcgtcactcttctgaa

SEQ ID NO: 309705 - DNA, 20 bp, Artificial Sequence
  Description of Artificial Sequence: Synthetic oligonucleotide
  Target: ATXN1; (+) strand; PAM type: YTN; PAM sequence: CTC
agcgtcactcttctgaattc

SEQ ID NO: 309706 - DNA, 20 bp, Artificial Sequence
  Description of Artificial Sequence: Synthetic oligonucleotide
  Target: ATXN1; (+) strand; PAM type: YTN; PAM sequence: CTC
ttctgaattccttcactgtt

SEQ ID NO: 309707 - DNA, 20 bp, Artificial Sequence
  Description of Artificial Sequence: Synthetic oligonucleotide
  Target: ATXN1; (+) strand; PAM type: YTN; PAM sequence: CTT
ctgaattccttcactgttag

SEQ ID NO: 309708 - DNA, 20 bp, Artificial Sequence
  Description of Artificial Sequence: Synthetic oligonucleotide
  Target: ATXN1; (+) strand; PAM type: YTN; PAM sequence: TTC
tgaattccttcactgttaga

SEQ ID NO: 309709 - DNA, 20 bp, Artificial Sequence
  Description of Artificial Sequence: Synthetic oligonucleotide
  Target: ATXN1; (+) strand; PAM type: YTN; PAM sequence: CTG
aattccttcactgttagaac

SEQ ID NO: 309710 - DNA, 20 bp, Artificial Sequence
  Description of Artificial Sequence: Synthetic oligonucleotide
  Target: ATXN1; (+) strand; PAM type: YTN; PAM sequence: TTC
cttcactgttagaacactgt

SEQ ID NO: 309711 - DNA, 20 bp, Artificial Sequence
  Description of Artificial Sequence: Synthetic oligonucleotide
  Target: ATXN1; (+) strand; PAM type: YTN; PAM sequence: CTT
cactgttagaacactgttag

SEQ ID NO: 309712 - DNA, 20 bp, Artificial Sequence
  Description of Artificial Sequence: Synthetic oligonucleotide
  Target: ATXN1; (+) strand; PAM type: YTN; PAM sequence: TTC
actgttagaacactgttaga

SEQ ID NO: 309713 - DNA, 20 bp, Artificial Sequence
  Description of Artificial Sequence: Synthetic oligonucleotide
  Target: ATXN1; (+) strand; PAM type: YTN; PAM sequence: CTG
ttagaacactgttagaaccc

SEQ ID NO: 309714 - DNA, 20 bp, Artificial Sequence
  Description of Artificial Sequence: Synthetic oligonucleotide
  Target: ATXN1; (+) strand; PAM type: YTN; PAM sequence: TTA
gaacactgttagaaccccat

SEQ ID NO: 309715 - DNA, 20 bp, Artificial Sequence
  Description of Artificial Sequence: Synthetic oligonucleotide
  Target: ATXN1; (+) strand; PAM type: YTN; PAM sequence: CTG
ttagaaccccattctattcg

SEQ ID NO: 309716 - DNA, 20 bp, Artificial Sequence
  Description of Artificial Sequence: Synthetic oligonucleotide
  Target: ATXN1; (+) strand; PAM type: YTN; PAM sequence: TTA
gaaccccattctattcgtat

SEQ ID NO: 309717 - DNA, 20 bp, Artificial Sequence
  Description of Artificial Sequence: Synthetic oligonucleotide
  Target: ATXN1; (+) strand; PAM type: YTN; PAM sequence: TTC
tattcgtattcattatttca

SEQ ID NO: 309718 - DNA, 20 bp, Artificial Sequence
  Description of Artificial Sequence: Synthetic oligonucleotide
  Target: ATXN1; (+) strand; PAM type: YTN; PAM sequence: CTA
ttcgtattcattatttcaga

SEQ ID NO: 309719 - DNA, 20 bp, Artificial Sequence
  Description of Artificial Sequence: Synthetic oligonucleotide
  Target: ATXN1; (+) strand; PAM type: YTN; PAM sequence: TTC
gtattcattatttcagagag

SEQ ID NO: 309720 - DNA, 20 bp, Artificial Sequence
  Description of Artificial Sequence: Synthetic oligonucleotide
  Target: ATXN1; (+) strand; PAM type: YTN; PAM sequence: TTC
attatttcagagagtttctt

SEQ ID NO: 309721 - DNA, 20 bp, Artificial Sequence
  Description of Artificial Sequence: Synthetic oligonucleotide
  Target: ATXN1; (+) strand; PAM type: YTN; PAM sequence: TTA
tttcagagagtttcttcttt

SEQ ID NO: 309722 - DNA, 20 bp, Artificial Sequence
  Description of Artificial Sequence: Synthetic oligonucleotide
  Target: ATXN1; (+) strand; PAM type: YTN; PAM sequence: TTT
cagagagtttcttctttccc

SEQ ID NO: 309723 - DNA, 20 bp, Artificial Sequence
  Description of Artificial Sequence: Synthetic oligonucleotide
  Target: ATXN1; (+) strand; PAM type: YTN; PAM sequence: TTC
agagagtttcttctttcccc

SEQ ID NO: 309724 - DNA, 20 bp, Artificial Sequence
  Description of Artificial Sequence: Synthetic oligonucleotide
  Target: ATXN1; (+) strand; PAM type: YTN; PAM sequence: TTT
cttctttcccctgcctgacc

SEQ ID NO: 309725 - DNA, 20 bp, Artificial Sequence
  Description of Artificial Sequence: Synthetic oligonucleotide
  Target: ATXN1; (+) strand; PAM type: YTN; PAM sequence: TTC
ttctttcccctgcctgacca

SEQ ID NO: 309726 - DNA, 20 bp, Artificial Sequence
  Description of Artificial Sequence: Synthetic oligonucleotide
  Target: ATXN1; (+) strand; PAM type: YTN; PAM sequence: CTT
ctttcccctgcctgaccagg

SEQ ID NO: 309727 - DNA, 20 bp, Artificial Sequence
  Description of Artificial Sequence: Synthetic oligonucleotide
  Target: ATXN1; (+) strand; PAM type: YTN; PAM sequence: TTC
tttcccctgcctgaccagga

SEQ ID NO: 309728 - DNA, 20 bp, Artificial Sequence
  Description of Artificial Sequence: Synthetic oligonucleotide
  Target: ATXN1; (+) strand; PAM type: YTN; PAM sequence: CTT
tcccctgcctgaccaggaag

SEQ ID NO: 309729 - DNA, 20 bp, Artificial Sequence
  Description of Artificial Sequence: Synthetic oligonucleotide
  Target: ATXN1; (+) strand; PAM type: YTN; PAM sequence: TTT
cccctgcctgaccaggaaga

SEQ ID NO: 309730 - DNA, 20 bp, Artificial Sequence
  Description of Artificial Sequence: Synthetic oligonucleotide
  Target: ATXN1; (+) strand; PAM type: YTN; PAM sequence: TTC
ccctgcctgaccaggaagaa

SEQ ID NO: 309731 - DNA, 20 bp, Artificial Sequence
  Description of Artificial Sequence: Synthetic oligonucleotide
  Target: ATXN1; (+) strand; PAM type: YTN; PAM sequence: CTG
cctgaccaggaagaaaataa

SEQ ID NO: 309732 - DNA, 20 bp, Artificial Sequence
  Description of Artificial Sequence: Synthetic oligonucleotide
  Target: ATXN1; (+) strand; PAM type: YTN; PAM sequence: CTG
accaggaagaaaataactgc

SEQ ID NO: 309733 - DNA, 20 bp, Artificial Sequence
  Description of Artificial Sequence: Synthetic oligonucleotide
  Target: ATXN1; (+) strand; PAM type: YTN; PAM sequence: CTG
ccttccggtagctcttattc

SEQ ID NO: 309734 - DNA, 20 bp, Artificial Sequence
  Description of Artificial Sequence: Synthetic oligonucleotide
  Target: ATXN1; (+) strand; PAM type: YTN; PAM sequence: CTT
ccggtagctcttattcactt

SEQ ID NO: 309735 - DNA, 20 bp, Artificial Sequence
  Description of Artificial Sequence: Synthetic oligonucleotide
  Target: ATXN1; (+) strand; PAM type: YTN; PAM sequence: TTC
cggtagctcttattcacttc

SEQ ID NO: 309736 - DNA, 20 bp, Artificial Sequence
  Description of Artificial Sequence: Synthetic oligonucleotide
  Target: ATXN1; (+) strand; PAM type: YTN; PAM sequence: CTC
ttattcacttccattcccac

SEQ ID NO: 309737 - DNA, 20 bp, Artificial Sequence
  Description of Artificial Sequence: Synthetic oligonucleotide
  Target: ATXN1; (+) strand; PAM type: YTN; PAM sequence: CTT
attcacttccattcccacag

SEQ ID NO: 309738 - DNA, 20 bp, Artificial Sequence
  Description of Artificial Sequence: Synthetic oligonucleotide
  Target: ATXN1; (+) strand; PAM type: YTN; PAM sequence: TTA
ttcacttccattcccacagc

SEQ ID NO: 309739 - DNA, 20 bp, Artificial Sequence
  Description of Artificial Sequence: Synthetic oligonucleotide
  Target: ATXN1; (+) strand; PAM type: YTN; PAM sequence: TTC
acttccattcccacagcacc

SEQ ID NO: 309740 - DNA, 20 bp, Artificial Sequence
  Description of Artificial Sequence: Synthetic oligonucleotide
  Target: ATXN1; (+) strand; PAM type: YTN; PAM sequence: CTT
ccattcccacagcaccatgc

SEQ ID NO: 309741 - DNA, 20 bp, Artificial Sequence
  Description of Artificial Sequence: Synthetic oligonucleotide
  Target: ATXN1; (+) strand; PAM type: YTN; PAM sequence: TTC
cattcccacagcaccatgca

SEQ ID NO: 309742 - DNA, 20 bp, Artificial Sequence
  Description of Artificial Sequence: Synthetic oligonucleotide
  Target: ATXN1; (+) strand; PAM type: YTN; PAM sequence: TTC
ccacagcaccatgcagtagt

SEQ ID NO: 309743 - DNA, 20 bp, Artificial Sequence
  Description of Artificial Sequence: Synthetic oligonucleotide
  Target: ATXN1; (+) strand; PAM type: YTN; PAM sequence: TTT
taaaaaaattcacaatgaat

SEQ ID NO: 309744 - DNA, 20 bp, Artificial Sequence
  Description of Artificial Sequence: Synthetic oligonucleotide
  Target: ATXN1; (+) strand; PAM type: YTN; PAM sequence: TTT
aaaaaaattcacaatgaata

SEQ ID NO: 309745 - DNA, 20 bp, Artificial Sequence
  Description of Artificial Sequence: Synthetic oligonucleotide
  Target: ATXN1; (+) strand; PAM type: YTN; PAM sequence: TTA
aaaaaattcacaatgaataa

SEQ ID NO: 309746 - DNA, 20 bp, Artificial Sequence
  Description of Artificial Sequence: Synthetic oligonucleotide
  Target: ATXN1; (+) strand; PAM type: YTN; PAM sequence: TTC
acaatgaataaatgaatgaa

SEQ ID NO: 309747 - DNA, 20 bp, Artificial Sequence
  Description of Artificial Sequence: Synthetic oligonucleotide
  Target: ATXN1; (+) strand; PAM type: YTN; PAM sequence: TTT
ctttacataaatagtgactg

SEQ ID NO: 309748 - DNA, 20 bp, Artificial Sequence
  Description of Artificial Sequence: Synthetic oligonucleotide
  Target: ATXN1; (+) strand; PAM type: YTN; PAM sequence: TTC
tttacataaatagtgactgt

SEQ ID NO: 309749 - DNA, 20 bp, Artificial Sequence
  Description of Artificial Sequence: Synthetic oligonucleotide
  Target: ATXN1; (+) strand; PAM type: YTN; PAM sequence: CTT
tacataaatagtgactgtga

SEQ ID NO: 309750 - DNA, 20 bp, Artificial Sequence
  Description of Artificial Sequence: Synthetic oligonucleotide
  Target: ATXN1; (+) strand; PAM type: YTN; PAM sequence: TTT
acataaatagtgactgtgaa

SEQ ID NO: 309751 - DNA, 20 bp, Artificial Sequence
  Description of Artificial Sequence: Synthetic oligonucleotide
  Target: ATXN1; (+) strand; PAM type: YTN; PAM sequence: TTA
cataaatagtgactgtgaac

SEQ ID NO: 309752 - DNA, 20 bp, Artificial Sequence
  Description of Artificial Sequence: Synthetic oligonucleotide
  Target: ATXN1; (+) strand; PAM type: YTN; PAM sequence: CTG
tgaacaagttaggtcataac

SEQ ID NO: 309753 - DNA, 20 bp, Artificial Sequence
  Description of Artificial Sequence: Synthetic oligonucleotide
  Target: ATXN1; (+) strand; PAM type: YTN; PAM sequence: TTA
ggtcataacttgctatagct

SEQ ID NO: 309754 - DNA, 20 bp, Artificial Sequence
  Description of Artificial Sequence: Synthetic oligonucleotide
  Target: ATXN1; (+) strand; PAM type: YTN; PAM sequence: CTT
gctatagctgtatcatattt

SEQ ID NO: 309755 - DNA, 20 bp, Artificial Sequence
  Description of Artificial Sequence: Synthetic oligonucleotide
  Target: ATXN1; (+) strand; PAM type: YTN; PAM sequence: TTG
ctatagctgtatcatattta

SEQ ID NO: 309756 - DNA, 20 bp, Artificial Sequence
  Description of Artificial Sequence: Synthetic oligonucleotide
  Target: ATXN1; (+) strand; PAM type: YTN; PAM sequence: CTA
tagctgtatcatatttataa

SEQ ID NO: 309757 - DNA, 20 bp, Artificial Sequence
  Description of Artificial Sequence: Synthetic oligonucleotide
  Target: ATXN1; (+) strand; PAM type: YTN; PAM sequence: CTG
tatcatatttataaaataac

SEQ ID NO: 309758 - DNA, 20 bp, Artificial Sequence
  Description of Artificial Sequence: Synthetic oligonucleotide
  Target: ATXN1; (+) strand; PAM type: YTN; PAM sequence: TTT
ataaaataactagaaccaga

SEQ ID NO: 309759 - DNA, 20 bp, Artificial Sequence
  Description of Artificial Sequence: Synthetic oligonucleotide
  Target: ATXN1; (+) strand; PAM type: YTN; PAM sequence: TTA
taaaataactagaaccagaa

SEQ ID NO: 309760 - DNA, 20 bp, Artificial Sequence
  Description of Artificial Sequence: Synthetic oligonucleotide
  Target: ATXN1; (+) strand; PAM type: YTN; PAM sequence: CTA
gaaccagaaagaactataat

SEQ ID NO: 309761 - DNA, 20 bp, Artificial Sequence
  Description of Artificial Sequence: Synthetic oligonucleotide
  Target: ATXN1; (+) strand; PAM type: YTN; PAM sequence: CTA
taatgtaggtttaagaaaaa

SEQ ID NO: 309762 - DNA, 20 bp, Artificial Sequence
  Description of Artificial Sequence: Synthetic oligonucleotide
  Target: ATXN1; (+) strand; PAM type: YTN; PAM sequence: TTT
aagaaaaaaactgaatgaat

SEQ ID NO: 309763 - DNA, 20 bp, Artificial Sequence
  Description of Artificial Sequence: Synthetic oligonucleotide
  Target: ATXN1; (+) strand; PAM type: YTN; PAM sequence: TTA
agaaaaaaactgaatgaata

SEQ ID NO: 309764 - DNA, 20 bp, Artificial Sequence
  Description of Artificial Sequence: Synthetic oligonucleotide
  Target: ATXN1; (+) strand; PAM type: YTN; PAM sequence: CTG
aatgaatataaaagagtaca

SEQ ID NO: 309765 - DNA, 20 bp, Artificial Sequence
  Description of Artificial Sequence: Synthetic oligonucleotide
  Target: ATXN1; (+) strand; PAM type: YTN; PAM sequence: CTA
tttttctgcctacgttgagc

SEQ ID NO: 309766 - DNA, 20 bp, Artificial Sequence
  Description of Artificial Sequence: Synthetic oligonucleotide
  Target: ATXN1; (+) strand; PAM type: YTN; PAM sequence: TTT
ttctgcctacgttgagccgt

SEQ ID NO: 309767 - DNA, 20 bp, Artificial Sequence
  Description of Artificial Sequence: Synthetic oligonucleotide
  Target: ATXN1; (+) strand; PAM type: YTN; PAM sequence: TTT
tctgcctacgttgagccgtc

SEQ ID NO: 309768 - DNA, 20 bp, Artificial Sequence
  Description of Artificial Sequence: Synthetic oligonucleotide
  Target: ATXN1; (+) strand; PAM type: YTN; PAM sequence: TTT
ctgcctacgttgagccgtca

SEQ ID NO: 309769 - DNA, 20 bp, Artificial Sequence
  Description of Artificial Sequence: Synthetic oligonucleotide
  Target: ATXN1; (+) strand; PAM type: YTN; PAM sequence: TTC
tgcctacgttgagccgtcaa

SEQ ID NO: 309770 - DNA, 20 bp, Artificial Sequence
  Description of Artificial Sequence: Synthetic oligonucleotide
  Target: ATXN1; (+) strand; PAM type: YTN; PAM sequence: CTG
cctacgttgagccgtcaatc

SEQ ID NO: 309771 - DNA, 20 bp, Artificial Sequence
  Description of Artificial Sequence: Synthetic oligonucleotide
  Target: ATXN1; (+) strand; PAM type: YTN; PAM sequence: CTA
cgttgagccgtcaatcgtga

SEQ ID NO: 309772 - DNA, 20 bp, Artificial Sequence
  Description of Artificial Sequence: Synthetic oligonucleotide
  Target: ATXN1; (+) strand; PAM type: YTN; PAM sequence: TTG
agccgtcaatcgtgaggact

SEQ ID NO: 309773 - DNA, 20 bp, Artificial Sequence
  Description of Artificial Sequence: Synthetic oligonucleotide
  Target: ATXN1; (+) strand; PAM type: YTN; PAM sequence: CTG
taatgaggccattattgatg

SEQ ID NO: 309774 - DNA, 20 bp, Artificial Sequence
  Description of Artificial Sequence: Synthetic oligonucleotide
  Target: ATXN1; (+) strand; PAM type: YTN; PAM sequence: TTA
ttgatgcaaaatgtttagat

SEQ ID NO: 309775 - DNA, 20 bp, Artificial Sequence
  Description of Artificial Sequence: Synthetic oligonucleotide
  Target: ATXN1; (+) strand; PAM type: YTN; PAM sequence: TTG
atgcaaaatgtttagataat

SEQ ID NO: 309776 - DNA, 20 bp, Artificial Sequence
  Description of Artificial Sequence: Synthetic oligonucleotide
  Target: ATXN1; (+) strand; PAM type: YTN; PAM sequence: TTT
agataatgcttataagcttt

SEQ ID NO: 309777 - DNA, 20 bp, Artificial Sequence
  Description of Artificial Sequence: Synthetic oligonucleotide
  Target: ATXN1; (+) strand; PAM type: YTN; PAM sequence: TTA
gataatgcttataagctttc

SEQ ID NO: 309778 - DNA, 20 bp, Artificial Sequence
  Description of Artificial Sequence: Synthetic oligonucleotide
  Target: ATXN1; (+) strand; PAM type: YTN; PAM sequence: CTT
ataagctttctttaaatgca

SEQ ID NO: 309779 - DNA, 20 bp, Artificial Sequence
  Description of Artificial Sequence: Synthetic oligonucleotide
  Target: ATXN1; (+) strand; PAM type: YTN; PAM sequence: TTA
taagctttctttaaatgcaa

SEQ ID NO: 309780 - DNA, 20 bp, Artificial Sequence
  Description of Artificial Sequence: Synthetic oligonucleotide
  Target: ATXN1; (+) strand; PAM type: YTN; PAM sequence: CTT
tctttaaatgcaatcataga

SEQ ID NO: 309781 - DNA, 20 bp, Artificial Sequence
  Description of Artificial Sequence: Synthetic oligonucleotide
  Target: ATXN1; (+) strand; PAM type: YTN; PAM sequence: TTT
ctttaaatgcaatcatagaa

SEQ ID NO: 309782 - DNA, 20 bp, Artificial Sequence
  Description of Artificial Sequence: Synthetic oligonucleotide
  Target: ATXN1; (+) strand; PAM type: YTN; PAM sequence: TTC
tttaaatgcaatcatagaaa

SEQ ID NO: 309783 - DNA, 20 bp, Artificial Sequence
  Description of Artificial Sequence: Synthetic oligonucleotide
  Target: ATXN1; (+) strand; PAM type: YTN; PAM sequence: CTT
taaatgcaatcatagaaaat

SEQ ID NO: 309784 - DNA, 20 bp, Artificial Sequence
  Description of Artificial Sequence: Synthetic oligonucleotide
  Target: ATXN1; (+) strand; PAM type: YTN; PAM sequence: TTT
aaatgcaatcatagaaaatg

SEQ ID NO: 309785 - DNA, 20 bp, Artificial Sequence
  Description of Artificial Sequence: Synthetic oligonucleotide
  Target: ATXN1; (+) strand; PAM type: YTN; PAM sequence: TTA
aatgcaatcatagaaaatgt

SEQ ID NO: 309786 - DNA, 20 bp, Artificial Sequence
  Description of Artificial Sequence: Synthetic oligonucleotide
  Target: ATXN1; (+) strand; PAM type: YTN; PAM sequence: CTT
aaaattcaaggtgactttgc

SEQ ID NO: 309787 - DNA, 20 bp, Artificial Sequence
  Description of Artificial Sequence: Synthetic oligonucleotide
  Target: ATXN1; (+) strand; PAM type: YTN; PAM sequence: TTA
aaattcaaggtgactttgcg

SEQ ID NO: 309788 - DNA, 20 bp, Artificial Sequence
  Description of Artificial Sequence: Synthetic oligonucleotide
  Target: ATXN1; (+) strand; PAM type: YTN; PAM sequence: TTC
aaggtgactttgcgctactt

SEQ ID NO: 309789 - DNA, 20 bp, Artificial Sequence
  Description of Artificial Sequence: Synthetic oligonucleotide
  Target: ATXN1; (+) strand; PAM type: YTN; PAM sequence: CTT
tgcgctacttcgtcagtatt

SEQ ID NO: 309790 - DNA, 20 bp, Artificial Sequence
  Description of Artificial Sequence: Synthetic oligonucleotide
  Target: ATXN1; (+) strand; PAM type: YTN; PAM sequence: TTT
gcgctacttcgtcagtattt

SEQ ID NO: 309791 - DNA, 20 bp, Artificial Sequence
  Description of Artificial Sequence: Synthetic oligonucleotide
  Target: ATXN1; (+) strand; PAM type: YTN; PAM sequence: TTG
cgctacttcgtcagtatttt

SEQ ID NO: 309792 - DNA, 20 bp, Artificial Sequence
  Description of Artificial Sequence: Synthetic oligonucleotide
  Target: ATXN1; (+) strand; PAM type: YTN; PAM sequence: CTA
cttcgtcagtattttagtat

SEQ ID NO: 309793 - DNA, 20 bp, Artificial Sequence
  Description of Artificial Sequence: Synthetic oligonucleotide
  Target: ATXN1; (+) strand; PAM type: YTN; PAM sequence: CTT
cgtcagtattttagtattca

SEQ ID NO: 309794 - DNA, 20 bp, Artificial Sequence
  Description of Artificial Sequence: Synthetic oligonucleotide
  Target: ATXN1; (+) strand; PAM type: YTN; PAM sequence: TTC
gtcagtattttagtattcat

SEQ ID NO: 309795 - DNA, 20 bp, Artificial Sequence
  Description of Artificial Sequence: Synthetic oligonucleotide
  Target: ATXN1; (+) strand; PAM type: YTN; PAM sequence: TTT
tagtattcataagacactta

SEQ ID NO: 309796 - DNA, 20 bp, Artificial Sequence
  Description of Artificial Sequence: Synthetic oligonucleotide
  Target: ATXN1; (+) strand; PAM type: YTN; PAM sequence: TTT
agtattcataagacacttaa

SEQ ID NO: 309797 - DNA, 20 bp, Artificial Sequence
  Description of Artificial Sequence: Synthetic oligonucleotide
  Target: ATXN1; (+) strand; PAM type: YTN; PAM sequence: TTA
gtattcataagacacttaaa

SEQ ID NO: 309798 - DNA, 20 bp, Artificial Sequence
  Description of Artificial Sequence: Synthetic oligonucleotide
  Target: ATXN1; (+) strand; PAM type: YTN; PAM sequence: TTC
ataagacacttaaacttgcc

SEQ ID NO: 309799 - DNA, 20 bp, Artificial Sequence
  Description of Artificial Sequence: Synthetic oligonucleotide
  Target: ATXN1; (+) strand; PAM type: YTN; PAM sequence: CTT
aaacttgcctaacatattat

SEQ ID NO: 309800 - DNA, 20 bp, Artificial Sequence
  Description of Artificial Sequence: Synthetic oligonucleotide
  Target: ATXN1; (+) strand; PAM type: YTN; PAM sequence: TTA
aacttgcctaacatattata

SEQ ID NO: 309801 - DNA, 20 bp, Artificial Sequence
  Description of Artificial Sequence: Synthetic oligonucleotide
  Target: ATXN1; (+) strand; PAM type: YTN; PAM sequence: CTT
gcctaacatattataaaaac

SEQ ID NO: 309802 - DNA, 20 bp, Artificial Sequence
  Description of Artificial Sequence: Synthetic oligonucleotide
  Target: ATXN1; (+) strand; PAM type: YTN; PAM sequence: TTG
cctaacatattataaaaacc

SEQ ID NO: 309803 - DNA, 20 bp, Artificial Sequence
  Description of Artificial Sequence: Synthetic oligonucleotide
  Target: ATXN1; (+) strand; PAM type: YTN; PAM sequence: CTA
acatattataaaaacctagg

SEQ ID NO: 309804 - DNA, 20 bp, Artificial Sequence
  Description of Artificial Sequence: Synthetic oligonucleotide
  Target: ATXN1; (+) strand; PAM type: YTN; PAM sequence: TTA
taaaaacctaggtctcttct

SEQ ID NO: 309805 - DNA, 20 bp, Artificial Sequence
  Description of Artificial Sequence: Synthetic oligonucleotide
  Target: ATXN1; (+) strand; PAM type: YTN; PAM sequence: CTA
ggtctcttctcaataagctg

SEQ ID NO: 309806 - DNA, 20 bp, Artificial Sequence
  Description of Artificial Sequence: Synthetic oligonucleotide
  Target: ATXN1; (+) strand; PAM type: YTN; PAM sequence: CTC
ttctcaataagctgcccata

SEQ ID NO: 309807 - DNA, 20 bp, Artificial Sequence
  Description of Artificial Sequence: Synthetic oligonucleotide
  Target: ATXN1; (+) strand; PAM type: YTN; PAM sequence: CTT
ctcaataagctgcccatatt

SEQ ID NO: 309808 - DNA, 20 bp, Artificial Sequence
  Description of Artificial Sequence: Synthetic oligonucleotide
  Target: ATXN1; (+) strand; PAM type: YTN; PAM sequence: TTC
tcaataagctgcccatattg

SEQ ID NO: 309809 - DNA, 20 bp, Artificial Sequence
  Description of Artificial Sequence: Synthetic oligonucleotide
  Target: ATXN1; (+) strand; PAM type: YTN; PAM sequence: CTC
aataagctgcccatattgac

SEQ ID NO: 309810 - DNA, 20 bp, Artificial Sequence
  Description of Artificial Sequence: Synthetic oligonucleotide
  Target: ATXN1; (+) strand; PAM type: YTN; PAM sequence: CTG
cccatattgaccaagagata

SEQ ID NO: 309811 - DNA, 20 bp, Artificial Sequence
  Description of Artificial Sequence: Synthetic oligonucleotide
  Target: ATXN1; (+) strand; PAM type: YTN; PAM sequence: TTG
accaagagatatgacttttt

SEQ ID NO: 309812 - DNA, 20 bp, Artificial Sequence
  Description of Artificial Sequence: Synthetic oligonucleotide
  Target: ATXN1; (+) strand; PAM type: YTN; PAM sequence: CTT
tttgctgcctgttttttcac

SEQ ID NO: 309813 - DNA, 20 bp, Artificial Sequence
  Description of Artificial Sequence: Synthetic oligonucleotide
  Target: ATXN1; (+) strand; PAM type: YTN; PAM sequence: TTT
ttgctgcctgttttttcaca

SEQ ID NO: 309814 - DNA, 20 bp, Artificial Sequence
  Description of Artificial Sequence: Synthetic oligonucleotide
  Target: ATXN1; (+) strand; PAM type: YTN; PAM sequence: TTT
tgctgcctgttttttcacaa

SEQ ID NO: 309815 - DNA, 20 bp, Artificial Sequence
  Description of Artificial Sequence: Synthetic oligonucleotide
  Target: ATXN1; (+) strand; PAM type: YTN; PAM sequence: TTT
gctgcctgttttttcacaat

SEQ ID NO: 309816 - DNA, 20 bp, Artificial Sequence
  Description of Artificial Sequence: Synthetic oligonucleotide
  Target: ATXN1; (+) strand; PAM type: YTN; PAM sequence: TTG
ctgcctgttttttcacaata

SEQ ID NO: 309817 - DNA, 20 bp, Artificial Sequence
  Description of Artificial Sequence: Synthetic oligonucleotide
  Target: ATXN1; (+) strand; PAM type: YTN; PAM sequence: CTG
cctgttttttcacaataaaa

SEQ ID NO: 309818 - DNA, 20 bp, Artificial Sequence
  Description of Artificial Sequence: Synthetic oligonucleotide
  Target: ATXN1; (+) strand; PAM type: YTN; PAM sequence: CTG
ttttttcacaataaaattct

SEQ ID NO: 309819 - DNA, 20 bp, Artificial Sequence
  Description of Artificial Sequence: Synthetic oligonucleotide
  Target: ATXN1; (+) strand; PAM type: YTN; PAM sequence: TTT
tttcacaataaaattcttga

SEQ ID NO: 309820 - DNA, 20 bp, Artificial Sequence
  Description of Artificial Sequence: Synthetic oligonucleotide
  Target: ATXN1; (+) strand; PAM type: YTN; PAM sequence: TTT
ttcacaataaaattcttgag

SEQ ID NO: 309821 - DNA, 20 bp, Artificial Sequence
  Description of Artificial Sequence: Synthetic oligonucleotide
  Target: ATXN1; (+) strand; PAM type: YTN; PAM sequence: TTT
tcacaataaaattcttgaga

SEQ ID NO: 309822 - DNA, 20 bp, Artificial Sequence
  Description of Artificial Sequence: Synthetic oligonucleotide
  Target: ATXN1; (+) strand; PAM type: YTN; PAM sequence: TTT
cacaataaaattcttgagat

SEQ ID NO: 309823 - DNA, 20 bp, Artificial Sequence
  Description of Artificial Sequence: Synthetic oligonucleotide
  Target: ATXN1; (+) strand; PAM type: YTN; PAM sequence: TTC
acaataaaattcttgagata

SEQ ID NO: 309824 - DNA, 20 bp, Artificial Sequence
  Description of Artificial Sequence: Synthetic oligonucleotide
  Target: ATXN1; (+) strand; PAM type: YTN; PAM sequence: TTC
ttgagatatttctgttatca

SEQ ID NO: 309825 - DNA, 20 bp, Artificial Sequence
  Description of Artificial Sequence: Synthetic oligonucleotide
  Target: ATXN1; (+) strand; PAM type: YTN; PAM sequence: CTT
gagatatttctgttatcaca

SEQ ID NO: 309826 - DNA, 20 bp, Artificial Sequence
  Description of Artificial Sequence: Synthetic oligonucleotide
  Target: ATXN1; (+) strand; PAM type: YTN; PAM sequence: TTG
agatatttctgttatcacaa

SEQ ID NO: 309827 - DNA, 20 bp, Artificial Sequence
  Description of Artificial Sequence: Synthetic oligonucleotide
  Target: ATXN1; (+) strand; PAM type: YTN; PAM sequence: TTT
ctgttatcacaaatgactcc

SEQ ID NO: 309828 - DNA, 20 bp, Artificial Sequence
  Description of Artificial Sequence: Synthetic oligonucleotide
  Target: ATXN1; (+) strand; PAM type: YTN; PAM sequence: TTC
tgttatcacaaatgactccc

SEQ ID NO: 309829 - DNA, 20 bp, Artificial Sequence
  Description of Artificial Sequence: Synthetic oligonucleotide
  Target: ATXN1; (+) strand; PAM type: YTN; PAM sequence: CTG
ttatcacaaatgactccctt

SEQ ID NO: 309830 - DNA, 20 bp, Artificial Sequence
  Description of Artificial Sequence: Synthetic oligonucleotide
  Target: ATXN1; (+) strand; PAM type: YTN; PAM sequence: TTA
tcacaaatgactccctttca

SEQ ID NO: 309831 - DNA, 20 bp, Artificial Sequence
  Description of Artificial Sequence: Synthetic oligonucleotide
  Target: ATXN1; (+) strand; PAM type: YTN; PAM sequence: CTC
cctttcaacaccacaggtta

SEQ ID NO: 309832 - DNA, 20 bp, Artificial Sequence
  Description of Artificial Sequence: Synthetic oligonucleotide
  Target: ATXN1; (+) strand; PAM type: YTN; PAM sequence: CTT
tcaacaccacaggttaaaaa

SEQ ID NO: 309833 - DNA, 20 bp, Artificial Sequence
  Description of Artificial Sequence: Synthetic oligonucleotide
  Target: ATXN1; (+) strand; PAM type: YTN; PAM sequence: TTT
caacaccacaggttaaaaaa

SEQ ID NO: 309834 - DNA, 20 bp, Artificial Sequence
  Description of Artificial Sequence: Synthetic oligonucleotide
  Target: ATXN1; (+) strand; PAM type: YTN; PAM sequence: TTC
aacaccacaggttaaaaaaa

SEQ ID NO: 309835 - DNA, 20 bp, Artificial Sequence
  Description of Artificial Sequence: Synthetic oligonucleotide
  Target: ATXN1; (+) strand; PAM type: YTN; PAM sequence: TTA
aaaaaaatgcacgtgtactc

SEQ ID NO: 309836 - DNA, 20 bp, Artificial Sequence
  Description of Artificial Sequence: Synthetic oligonucleotide
  Target: ATXN1; (+) strand; PAM type: YTN; PAM sequence: CTC
aacccatttgcaattaaact

SEQ ID NO: 309837 - DNA, 20 bp, Artificial Sequence
  Description of Artificial Sequence: Synthetic oligonucleotide
  Target: ATXN1; (+) strand; PAM type: YTN; PAM sequence: TTT
gcaattaaactatttcccca

SEQ ID NO: 309838 - DNA, 20 bp, Artificial Sequence
  Description of Artificial Sequence: Synthetic oligonucleotide
  Target: ATXN1; (+) strand; PAM type: YTN; PAM sequence: TTG
caattaaactatttccccaa

SEQ ID NO: 309839 - DNA, 20 bp, Artificial Sequence
  Description of Artificial Sequence: Synthetic oligonucleotide
  Target: ATXN1; (+) strand; PAM type: YTN; PAM sequence: TTA
aactatttccccaaagatct

SEQ ID NO: 309840 - DNA, 20 bp, Artificial Sequence
  Description of Artificial Sequence: Synthetic oligonucleotide
  Target: ATXN1; (+) strand; PAM type: YTN; PAM sequence: CTA
tttccccaaagatctaaatg

SEQ ID NO: 309841 - DNA, 20 bp, Artificial Sequence
  Description of Artificial Sequence: Synthetic oligonucleotide
  Target: ATXN1; (+) strand; PAM type: YTN; PAM sequence: TTT
ccccaaagatctaaatgtga

SEQ ID NO: 309842 - DNA, 20 bp, Artificial Sequence
  Description of Artificial Sequence: Synthetic oligonucleotide
  Target: ATXN1; (+) strand; PAM type: YTN; PAM sequence: TTC
cccaaagatctaaatgtgag

SEQ ID NO: 309843 - DNA, 20 bp, Artificial Sequence
  Description of Artificial Sequence: Synthetic oligonucleotide
  Target: ATXN1; (+) strand; PAM type: YTN; PAM sequence: CTA
aatgtgaggattttcagcct

SEQ ID NO: 309844 - DNA, 20 bp, Artificial Sequence
  Description of Artificial Sequence: Synthetic oligonucleotide
  Target: ATXN1; (+) strand; PAM type: YTN; PAM sequence: TTT
tcagcctagcacataaccgt

SEQ ID NO: 309845 - DNA, 20 bp, Artificial Sequence
  Description of Artificial Sequence: Synthetic oligonucleotide
  Target: ATXN1; (+) strand; PAM type: YTN; PAM sequence: TTT
cagcctagcacataaccgtt

SEQ ID NO: 309846 - DNA, 20 bp, Artificial Sequence
  Description of Artificial Sequence: Synthetic oligonucleotide
  Target: ATXN1; (+) strand; PAM type: YTN; PAM sequence: TTC
agcctagcacataaccgtta

SEQ ID NO: 309847 - DNA, 20 bp, Artificial Sequence
  Description of Artificial Sequence: Synthetic oligonucleotide
  Target: ATXN1; (+) strand; PAM type: YTN; PAM sequence: CTA
gcacataaccgttaaaatga

SEQ ID NO: 309848 - DNA, 20 bp, Artificial Sequence
  Description of Artificial Sequence: Synthetic oligonucleotide
  Target: ATXN1; (+) strand; PAM type: YTN; PAM sequence: TTA
aaatgagtatcatccctaag

SEQ ID NO: 309849 - DNA, 20 bp, Artificial Sequence
  Description of Artificial Sequence: Synthetic oligonucleotide
  Target: ATXN1; (+) strand; PAM type: YTN; PAM sequence: CTA
agagataaagtagcagtaag

SEQ ID NO: 309850 - DNA, 20 bp, Artificial Sequence
  Description of Artificial Sequence: Synthetic oligonucleotide
  Target: ATXN1; (+) strand; PAM type: YTN; PAM sequence: CTC
tacctttttcttttctttcc

SEQ ID NO: 309851 - DNA, 20 bp, Artificial Sequence
  Description of Artificial Sequence: Synthetic oligonucleotide
  Target: ATXN1; (+) strand; PAM type: YTN; PAM sequence: CTA
cctttttcttttctttcctc

SEQ ID NO: 309852 - DNA, 20 bp, Artificial Sequence
  Description of Artificial Sequence: Synthetic oligonucleotide
  Target: ATXN1; (+) strand; PAM type: YTN; PAM sequence: CTT
tttcttttctttcctctctt

SEQ ID NO: 309853 - DNA, 20 bp, Artificial Sequence
  Description of Artificial Sequence: Synthetic oligonucleotide
  Target: ATXN1; (+) strand; PAM type: YTN; PAM sequence: TTT
ttcttttctttcctctcttt

SEQ ID NO: 309854 - DNA, 20 bp, Artificial Sequence
  Description of Artificial Sequence: Synthetic oligonucleotide
  Target: ATXN1; (+) strand; PAM type: YTN; PAM sequence: TTT
tcttttctttcctctctttt

SEQ ID NO: 309855 - DNA, 20 bp, Artificial Sequence
  Description of Artificial Sequence: Synthetic oligonucleotide
  Target: ATXN1; (+) strand; PAM type: YTN; PAM sequence: TTT
cttttctttcctctcttttt

SEQ ID NO: 309856 - DNA, 20 bp, Artificial Sequence
  Description of Artificial Sequence: Synthetic oligonucleotide
  Target: ATXN1; (+) strand; PAM type: YTN; PAM sequence: TTC
ttttctttcctctctttttt

SEQ ID NO: 309857 - DNA, 20 bp, Artificial Sequence
  Description of Artificial Sequence: Synthetic oligonucleotide
  Target: ATXN1; (+) strand; PAM type: YTN; PAM sequence: CTT
ttctttcctctctttttttt

SEQ ID NO: 309858 - DNA, 20 bp, Artificial Sequence
  Description of Artificial Sequence: Synthetic oligonucleotide
  Target: ATXN1; (+) strand; PAM type: YTN; PAM sequence: TTT
tctttcctctcttttttttt

SEQ ID NO: 309859 - DNA, 20 bp, Artificial Sequence
  Description of Artificial Sequence: Synthetic oligonucleotide
  Target: ATXN1; (+) strand; PAM type: YTN; PAM sequence: TTT
ctttcctctctttttttttt

SEQ ID NO: 309860 - DNA, 20 bp, Artificial Sequence
  Description of Artificial Sequence: Synthetic oligonucleotide
  Target: ATXN1; (+) strand; PAM type: YTN; PAM sequence: TTC
tttcctctcttttttttttt

SEQ ID NO: 309861 - DNA, 20 bp, Artificial Sequence
  Description of Artificial Sequence: Synthetic oligonucleotide
  Target: ATXN1; (+) strand; PAM type: YTN; PAM sequence: CTT
tcctctcttttttttttttt

SEQ ID NO: 309862 - DNA, 20 bp, Artificial Sequence
  Description of Artificial Sequence: Synthetic oligonucleotide
  Target: ATXN1; (+) strand; PAM type: YTN; PAM sequence: TTT
cctctctttttttttttttt

SEQ ID NO: 309863 - DNA, 20 bp, Artificial Sequence
  Description of Artificial Sequence: Synthetic oligonucleotide
  Target: ATXN1; (+) strand; PAM type: YTN; PAM sequence: TTC
ctctcttttttttttttttt

SEQ ID NO: 309864 - DNA, 20 bp, Artificial Sequence
  Description of Artificial Sequence: Synthetic oligonucleotide
  Target: ATXN1; (+) strand; PAM type: YTN; PAM sequence: CTC
tctttttttttttttttttt

SEQ ID NO: 309865 - DNA, 20 bp, Artificial Sequence
  Description of Artificial Sequence: Synthetic oligonucleotide
  Target: ATXN1; (+) strand; PAM type: YTN; PAM sequence: CTC
ttttttttttttttttttga

SEQ ID NO: 309866 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttttttgaga

SEQ ID NO: 309867 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagat

SEQ ID NO: 309868 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagatg

SEQ ID NO: 309869 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagatgg

SEQ ID NO: 309870 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagatgga

SEQ ID NO: 309871 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagatggag

SEQ ID NO: 309872 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagatggagt

SEQ ID NO: 309873 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagatggagtc

SEQ ID NO: 309874 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagatggagtct

SEQ ID NO: 309875 - DNA, 20 bp, Artificial Sequence
  Description of Artificial Sequence: Synthetic oligonucleotide
  Target: ATXN1; (+) strand; PAM type: YTN; PAM sequence: TTT
tttttttgagatggagtctc

SEQ ID NO: 309876 - DNA, 20 bp, Artificial Sequence
  Description of Artificial Sequence: Synthetic oligonucleotide
  Target: ATXN1; (+) strand; PAM type: YTN; PAM sequence: TTT
ttttttgagatggagtctca

SEQ ID NO: 309877 - DNA, 20 bp, Artificial Sequence
  Description of Artificial Sequence: Synthetic oligonucleotide
  Target: ATXN1; (+) strand; PAM type: YTN; PAM sequence: TTT
tttttgagatggagtctcac

SEQ ID NO: 309878 - DNA, 20 bp, Artificial Sequence
  Description of Artificial Sequence: Synthetic oligonucleotide
  Target: ATXN1; (+) strand; PAM type: YTN; PAM sequence: TTT
ttttgagatggagtctcact

SEQ ID NO: 309879 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtctcactc

SEQ ID NO: 309880 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtctcactct

SEQ ID NO: 309881 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtctcactctg

SEQ ID NO: 309882 - DNA, 20 bp, Artificial Sequence
  Description of Artificial Sequence: Synthetic oligonucleotide
  Target: ATXN1; (+) strand; PAM type: YTN; PAM sequence: TTT
gagatggagtctcactctgt

SEQ ID NO: 309883 - DNA, 20 bp, Artificial Sequence
  Description of Artificial Sequence: Synthetic oligonucleotide
  Target: ATXN1; (+) strand; PAM type: YTN; PAM sequence: TTG
agatggagtctcactctgtc

SEQ ID NO: 309884 - DNA, 20 bp, Artificial Sequence
  Description of Artificial Sequence: Synthetic oligonucleotide
  Target: ATXN1; (+) strand; PAM type: YTN; PAM sequence: CTC
actctgtcgcccaggctgga

SEQ ID NO: 309885 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggagtgc

SEQ ID NO: 309886 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggagtgcag

SEQ ID NO: 309887 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcgagacctg

SEQ ID NO: 309888 - DNA, 20 bp, Artificial Sequence
  Description of Artificial Sequence: Synthetic oligonucleotide
  Target: ATXN1; (+) strand; PAM type: YTN; PAM sequence: CTG
ggctcactgcaacctctgcc

SEQ ID NO: 309889 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctccag

SEQ ID NO: 309890 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctccaggatt

SEQ ID NO: 309891 - DNA, 20 bp, Artificial Sequence
  Description of Artificial Sequence: Synthetic oligonucleotide
  Target: ATXN1; (+) strand; PAM type: YTN; PAM sequence: CTC
tgcctccaggattcaagcga

SEQ ID NO: 309892 - DNA, 20 bp, Artificial Sequence
  Description of Artificial Sequence: Synthetic oligonucleotide
  Target: ATXN1; (+) strand; PAM type: YTN; PAM sequence: CTG
cctccaggattcaagcgatt

SEQ ID NO: 309893 - DNA, 20 bp, Artificial Sequence
  Description of Artificial Sequence: Synthetic oligonucleotide
  Target: ATXN1; (+) strand; PAM type: YTN; PAM sequence: CTC
caggattcaagcgattctcc

SEQ ID NO: 309894 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 309895 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagtgtcccaag

SEQ ID NO: 309896 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagtgtcccaagta

SEQ ID NO: 309897 - DNA, 20 bp, Artificial Sequence
  Description of Artificial Sequence: Synthetic oligonucleotide
  Target: ATXN1; (+) strand; PAM type: YTN; PAM sequence: CTG
cctcagtgtcccaagtagct

SEQ ID NO: 309898 - DNA, 20 bp, Artificial Sequence
  Description of Artificial Sequence: Synthetic oligonucleotide
  Target: ATXN1; (+) strand; PAM type: YTN; PAM sequence: CTC
agtgtcccaagtagctggga

SEQ ID NO: 309899 - DNA, 20 bp, Artificial Sequence
  Description of Artificial Sequence: Synthetic oligonucleotide
  Target: ATXN1; (+) strand; PAM type: YTN; PAM sequence: CTG
ggattacaggaacctgccac

SEQ ID NO: 309900 - DNA, 20 bp, Artificial Sequence
  Description of Artificial Sequence: Synthetic oligonucleotide
  Target: ATXN1; (+) strand; PAM type: YTN; PAM sequence: TTA
caggaacctgccacaatgcc

SEQ ID NO: 309901 - DNA, 20 bp, Artificial Sequence
  Description of Artificial Sequence: Synthetic oligonucleotide
  Target: ATXN1; (+) strand; PAM type: YTN; PAM sequence: CTG
ccacaatgcctggctaattt

SEQ ID NO: 309902 - DNA, 20 bp, Artificial Sequence
  Description of Artificial Sequence: Synthetic oligonucleotide
  Target: ATXN1; (+) strand; PAM type: YTN; PAM sequence: CTG
gctaatttttatatttttag

SEQ ID NO: 309903 - DNA, 20 bp, Artificial Sequence
  Description of Artificial Sequence: Synthetic oligonucleotide
  Target: ATXN1; (+) strand; PAM type: YTN; PAM sequence: CTA
atttttatatttttagtaga

SEQ ID NO: 309904 - DNA, 20 bp, Artificial Sequence
  Description of Artificial Sequence: Synthetic oligonucleotide
  Target: ATXN1; (+) strand; PAM type: YTN; PAM sequence: TTT
ttatatttttagtagagaca

SEQ ID NO: 309905 - DNA, 20 bp, Artificial Sequence
  Description of Artificial Sequence: Synthetic oligonucleotide
  Target: ATXN1; (+) strand; PAM type: YTN; PAM sequence: TTT
tatatttttagtagagacag

SEQ ID NO: 309906 - DNA, 20 bp, Artificial Sequence
  Description of Artificial Sequence: Synthetic oligonucleotide
  Target: ATXN1; (+) strand; PAM type: YTN; PAM sequence: TTT
atatttttagtagagacagg

SEQ ID NO: 309907 - DNA, 20 bp, Artificial Sequence
  Description of Artificial Sequence: Synthetic oligonucleotide
  Target: ATXN1; (+) strand; PAM type: YTN; PAM sequence: TTA
tatttttagtagagacagga

SEQ ID NO: 309908 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacaggatttca

SEQ ID NO: 309909 - DNA, 20 bp, Artificial Sequence
  Description of Artificial Sequence: Synthetic oligonucleotide
  Target: ATXN1; (+) strand; PAM type: YTN; PAM sequence: TTT
tagtagagacaggatttcat

SEQ ID NO: 309910 - DNA, 20 bp, Artificial Sequence
  Description of Artificial Sequence: Synthetic oligonucleotide
  Target: ATXN1; (+) strand; PAM type: YTN; PAM sequence: TTT
agtagagacaggatttcatc

SEQ ID NO: 309911 - DNA, 20 bp, Artificial Sequence
  Description of Artificial Sequence: Synthetic oligonucleotide
  Target: ATXN1; (+) strand; PAM type: YTN; PAM sequence: TTA
gtagagacaggatttcatca

SEQ ID NO: 309912 - DNA, 20 bp, Artificial Sequence
  Description of Artificial Sequence: Synthetic oligonucleotide
  Target: ATXN1; (+) strand; PAM type: YTN; PAM sequence: TTT
catcatgttggccaggctgg

SEQ ID NO: 309913 - DNA, 20 bp, Artificial Sequence
  Description of Artificial Sequence: Synthetic oligonucleotide
  Target: ATXN1; (+) strand; PAM type: YTN; PAM sequence: TTC
atcatgttggccaggctggt

SEQ ID NO: 309914 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtctcaaactc

SEQ ID NO: 309915 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctgacctca

SEQ ID NO: 309916 - DNA, 20 bp, Artificial Sequence
  Description of Artificial Sequence: Synthetic oligonucleotide
  Target: ATXN1; (+) strand; PAM type: YTN; PAM sequence: CTC
aaactcctgacctcaagtga

SEQ ID NO: 309917 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaagtgattcacc

SEQ ID NO: 309918 - DNA, 20 bp, Artificial Sequence
  Description of Artificial Sequence: Synthetic oligonucleotide
  Target: ATXN1; (+) strand; PAM type: YTN; PAM sequence: CTG
acctcaagtgattcacccac

SEQ ID NO: 309919 - DNA, 20 bp, Artificial Sequence
  Description of Artificial Sequence: Synthetic oligonucleotide
  Target: ATXN1; (+) strand; PAM type: YTN; PAM sequence: CTC
aagtgattcacccacctcag

SEQ ID NO: 309920 - DNA, 20 bp, Artificial Sequence
  Description of Artificial Sequence: Synthetic oligonucleotide
  Target: ATXN1; (+) strand; PAM type: YTN; PAM sequence: TTC
acccacctcagcctcccaaa

SEQ ID NO: 309921 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgctggga

SEQ ID NO: 309922 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattaaag

SEQ ID NO: 309923 - DNA, 20 bp, Artificial Sequence
  Description of Artificial Sequence: Synthetic oligonucleotide
  Target: ATXN1; (+) strand; PAM type: YTN; PAM sequence: CTG
ggattaaaggcatgagccac

SEQ ID NO: 309924 - DNA, 20 bp, Artificial Sequence
  Description of Artificial Sequence: Synthetic oligonucleotide
  Target: ATXN1; (+) strand; PAM type: YTN; PAM sequence: TTA
aaggcatgagccactgtgcc

SEQ ID NO: 309925 - DNA, 20 bp, Artificial Sequence
  Description of Artificial Sequence: Synthetic oligonucleotide
  Target: ATXN1; (+) strand; PAM type: YTN; PAM sequence: CTG
tgcctggcccaccctacctt

SEQ ID NO: 309926 - DNA, 20 bp, Artificial Sequence
  Description of Artificial Sequence: Synthetic oligonucleotide
  Target: ATXN1; (+) strand; PAM type: YTN; PAM sequence: CTG
gcccaccctacctttttcat

SEQ ID NO: 309927 - DNA, 20 bp, Artificial Sequence
  Description of Artificial Sequence: Synthetic oligonucleotide
  Target: ATXN1; (+) strand; PAM type: YTN; PAM sequence: CTA
cctttttcattcagctgaca

SEQ ID NO: 309928 - DNA, 20 bp, Artificial Sequence
  Description of Artificial Sequence: Synthetic oligonucleotide
  Target: ATXN1; (+) strand; PAM type: YTN; PAM sequence: CTT
tttcattcagctgacacttg

SEQ ID NO: 309929 - DNA, 20 bp, Artificial Sequence
  Description of Artificial Sequence: Synthetic oligonucleotide
  Target: ATXN1; (+) strand; PAM type: YTN; PAM sequence: TTT
ttcattcagctgacacttgt

SEQ ID NO: 309930 - DNA, 20 bp, Artificial Sequence
  Description of Artificial Sequence: Synthetic oligonucleotide
  Target: ATXN1; (+) strand; PAM type: YTN; PAM sequence: TTT
tcattcagctgacacttgta

SEQ ID NO: 309931 - DNA, 20 bp, Artificial Sequence
  Description of Artificial Sequence: Synthetic oligonucleotide
  Target: ATXN1; (+) strand; PAM type: YTN; PAM sequence: TTT
cattcagctgacacttgtag

SEQ ID NO: 309932 - DNA, 20 bp, Artificial Sequence
  Description of Artificial Sequence: Synthetic oligonucleotide
  Target: ATXN1; (+) strand; PAM type: YTN; PAM sequence: TTC
attcagctgacacttgtaga

SEQ ID NO: 309933 - DNA, 20 bp, Artificial Sequence
  Description of Artificial Sequence: Synthetic oligonucleotide
  Target: ATXN1; (+) strand; PAM type: YTN; PAM sequence: TTC
agctgacacttgtagatctt

SEQ ID NO: 309934 - DNA, 20 bp, Artificial Sequence
  Description of Artificial Sequence: Synthetic oligonucleotide
  Target: ATXN1; (+) strand; PAM type: YTN; PAM sequence: CTG
acacttgtagatcttaagag

SEQ ID NO: 309935 - DNA, 20 bp, Artificial Sequence
  Description of Artificial Sequence: Synthetic oligonucleotide
  Target: ATXN1; (+) strand; PAM type: YTN; PAM sequence: CTT
gtagatcttaagaggcttac

SEQ ID NO: 309936 - DNA, 20 bp, Artificial Sequence
  Description of Artificial Sequence: Synthetic oligonucleotide
  Target: ATXN1; (+) strand; PAM type: YTN; PAM sequence: TTG
tagatcttaagaggcttacc

SEQ ID NO: 309937 - DNA, 20 bp, Artificial Sequence
  Description of Artificial Sequence: Synthetic oligonucleotide
  Target: ATXN1; (+) strand; PAM type: YTN; PAM sequence: CTT
aagaggcttacctttgcatg

SEQ ID NO: 309938 - DNA, 20 bp, Artificial Sequence
  Description of Artificial Sequence: Synthetic oligonucleotide
  Target: ATXN1; (+) strand; PAM type: YTN; PAM sequence: TTA
agaggcttacctttgcatgt

SEQ ID NO: 309939 - DNA, 20 bp, Artificial Sequence
  Description of Artificial Sequence: Synthetic oligonucleotide
  Target: ATXN1; (+) strand; PAM type: YTN; PAM sequence: CTT
acctttgcatgtaactttag

SEQ ID NO: 309940 - DNA, 20 bp, Artificial Sequence
  Description of Artificial Sequence: Synthetic oligonucleotide
  Target: ATXN1; (+) strand; PAM type: YTN; PAM sequence: TTA
cctttgcatgtaactttagg

SEQ ID NO: 309941 - DNA, 20 bp, Artificial Sequence
  Description of Artificial Sequence: Synthetic oligonucleotide
  Target: ATXN1; (+) strand; PAM type: YTN; PAM sequence: CTT
tgcatgtaactttaggttac

SEQ ID NO: 309942 - DNA, 20 bp, Artificial Sequence
  Description of Artificial Sequence: Synthetic oligonucleotide
  Target: ATXN1; (+) strand; PAM type: YTN; PAM sequence: TTT
gcatgtaactttaggttaca

SEQ ID NO: 309943 - DNA, 20 bp, Artificial Sequence
  Description of Artificial Sequence: Synthetic oligonucleotide
  Target: ATXN1; (+) strand; PAM type: YTN; PAM sequence: TTG
catgtaactttaggttacat

SEQ ID NO: 309944 - DNA, 20 bp, Artificial Sequence
  Description of Artificial Sequence: Synthetic oligonucleotide
  Target: ATXN1; (+) strand; PAM type: YTN; PAM sequence: CTT
taggttacatttccacttaa

SEQ ID NO: 309945 - DNA, 20 bp, Artificial Sequence
  Description of Artificial Sequence: Synthetic oligonucleotide
  Target: ATXN1; (+) strand; PAM type: YTN; PAM sequence: TTT
aggttacatttccacttaaa

SEQ ID NO: 309946 - DNA, 20 bp, Artificial Sequence
  Description of Artificial Sequence: Synthetic oligonucleotide
  Target: ATXN1; (+) strand; PAM type: YTN; PAM sequence: TTA
ggttacatttccacttaaag

SEQ ID NO: 309947 - DNA, 20 bp, Artificial Sequence
  Description of Artificial Sequence: Synthetic oligonucleotide
  Target: ATXN1; (+) strand; PAM type: YTN; PAM sequence: TTA
catttccacttaaagaacac

SEQ ID NO: 309948 - DNA, 20 bp, Artificial Sequence
  Description of Artificial Sequence: Synthetic oligonucleotide
  Target: ATXN1; (+) strand; PAM type: YTN; PAM sequence: TTT
ccacttaaagaacacctctc

SEQ ID NO: 309949 - DNA, 20 bp, Artificial Sequence
  Description of Artificial Sequence: Synthetic oligonucleotide
  Target: ATXN1; (+) strand; PAM type: YTN; PAM sequence: TTC
cacttaaagaacacctctct

SEQ ID NO: 309950 - DNA, 20 bp, Artificial Sequence
  Description of Artificial Sequence: Synthetic oligonucleotide
  Target: ATXN1; (+) strand; PAM type: YTN; PAM sequence: CTT
aaagaacacctctctaatcc

SEQ ID NO: 309951 - DNA, 20 bp, Artificial Sequence
  Description of Artificial Sequence: Synthetic oligonucleotide
  Target: ATXN1; (+) strand; PAM type: YTN; PAM sequence: TTA
aagaacacctctctaatcca

SEQ ID NO: 309952 - DNA, 20 bp, Artificial Sequence
  Description of Artificial Sequence: Synthetic oligonucleotide
  Target: ATXN1; (+) strand; PAM type: YTN; PAM sequence: CTC
tctaatccacagccaataaa

SEQ ID NO: 309953 - DNA, 20 bp, Artificial Sequence
  Description of Artificial Sequence: Synthetic oligonucleotide
  Target: ATXN1; (+) strand; PAM type: YTN; PAM sequence: CTC
taatccacagccaataaaat

SEQ ID NO: 309954 - DNA, 20 bp, Artificial Sequence
  Description of Artificial Sequence: Synthetic oligonucleotide
  Target: ATXN1; (+) strand; PAM type: YTN; PAM sequence: CTA
atccacagccaataaaatgt

SEQ ID NO: 309955 - DNA, 20 bp, Artificial Sequence
  Description of Artificial Sequence: Synthetic oligonucleotide
  Target: ATXN1; (+) strand; PAM type: YTN; PAM sequence: TTC
catattttacaagagtatcg

SEQ ID NO: 309956 - DNA, 20 bp, Artificial Sequence
  Description of Artificial Sequence: Synthetic oligonucleotide
  Target: ATXN1; (+) strand; PAM type: YTN; PAM sequence: TTT
tacaagagtatcgtgtctgt

SEQ ID NO: 309957 - DNA, 20 bp, Artificial Sequence
  Description of Artificial Sequence: Synthetic oligonucleotide
  Target: ATXN1; (+) strand; PAM type: YTN; PAM sequence: TTT
acaagagtatcgtgtctgtg

SEQ ID NO: 309958 - DNA, 20 bp, Artificial Sequence
  Description of Artificial Sequence: Synthetic oligonucleotide
  Target: ATXN1; (+) strand; PAM type: YTN; PAM sequence: TTA
caagagtatcgtgtctgtga

SEQ ID NO: 309959 - DNA, 20 bp, Artificial Sequence
  Description of Artificial Sequence: Synthetic oligonucleotide
  Target: ATXN1; (+) strand; PAM type: YTN; PAM sequence: CTG
tgatgactcttccctcctcc

SEQ ID NO: 309960 - DNA, 20 bp, Artificial Sequence
  Description of Artificial Sequence: Synthetic oligonucleotide
  Target: ATXN1; (+) strand; PAM type: YTN; PAM sequence: CTC
ttccctcctccaccttgtcc

SEQ ID NO: 309961 - DNA, 20 bp, Artificial Sequence
  Description of Artificial Sequence: Synthetic oligonucleotide
  Target: ATXN1; (+) strand; PAM type: YTN; PAM sequence: CTT
ccctcctccaccttgtcccc

SEQ ID NO: 309962 - DNA, 20 bp, Artificial Sequence
  Description of Artificial Sequence: Synthetic oligonucleotide
  Target: ATXN1; (+) strand; PAM type: YTN; PAM sequence: TTC
cctcctccaccttgtccccc

SEQ ID NO: 309963 - DNA, 20 bp, Artificial Sequence
  Description of Artificial Sequence: Synthetic oligonucleotide
  Target: ATXN1; (+) strand; PAM type: YTN; PAM sequence: CTC
ctccaccttgtcccccactg

SEQ ID NO: 309964 - DNA, 20 bp, Artificial Sequence
  Description of Artificial Sequence: Synthetic oligonucleotide
  Target: ATXN1; (+) strand; PAM type: YTN; PAM sequence: CTC
caccttgtcccccactggga

SEQ ID NO: 309965 - DNA, 20 bp, Artificial Sequence
  Description of Artificial Sequence: Synthetic oligonucleotide
  Target: ATXN1; (+) strand; PAM type: YTN; PAM sequence: CTT
gtcccccactgggacttttt

SEQ ID NO: 309966 - DNA, 20 bp, Artificial Sequence
  Description of Artificial Sequence: Synthetic oligonucleotide
  Target: ATXN1; (+) strand; PAM type: YTN; PAM sequence: TTG
tcccccactgggactttttt

SEQ ID NO: 309967 - DNA, 20 bp, Artificial Sequence
  Description of Artificial Sequence: Synthetic oligonucleotide
  Target: ATXN1; (+) strand; PAM type: YTN; PAM sequence: CTG
ggacttttttggctgttttt

SEQ ID NO: 309968 - DNA, 20 bp, Artificial Sequence
  Description of Artificial Sequence: Synthetic oligonucleotide
  Target: ATXN1; (+) strand; PAM type: YTN; PAM sequence: CTT
ttttggctgtttttcctgag

SEQ ID NO: 309969 - DNA, 20 bp, Artificial Sequence
  Description of Artificial Sequence: Synthetic oligonucleotide
  Target: ATXN1; (+) strand; PAM type: YTN; PAM sequence: TTT
tttggctgtttttcctgagg

SEQ ID NO: 309970 - DNA, 20 bp, Artificial Sequence
  Description of Artificial Sequence: Synthetic oligonucleotide
  Target: ATXN1; (+) strand; PAM type: YTN; PAM sequence: TTT
ttggctgtttttcctgaggc

SEQ ID NO: 309971 - DNA, 20 bp, Artificial Sequence
  Description of Artificial Sequence: Synthetic oligonucleotide
  Target: ATXN1; (+) strand; PAM type: YTN; PAM sequence: TTT
tggctgtttttcctgaggca

SEQ ID NO: 309972 - DNA, 20 bp, Artificial Sequence
  Description of Artificial Sequence: Synthetic oligonucleotide
  Target: ATXN1; (+) strand; PAM type: YTN; PAM sequence: TTT
ggctgtttttcctgaggcat

SEQ ID NO: 309973 - DNA, 20 bp, Artificial Sequence
  Description of Artificial Sequence: Synthetic oligonucleotide
  Target: ATXN1; (+) strand; PAM type: YTN; PAM sequence: TTG
gctgtttttcctgaggcata

SEQ ID NO: 309974 - DNA, 20 bp, Artificial Sequence
  Description of Artificial Sequence: Synthetic oligonucleotide
  Target: ATXN1; (+) strand; PAM type: YTN; PAM sequence: CTG
tttttcctgaggcataatac

SEQ ID NO: 309975 - DNA, 20 bp, Artificial Sequence
  Description of Artificial Sequence: Synthetic oligonucleotide
  Target: ATXN1; (+) strand; PAM type: YTN; PAM sequence: TTT
ttcctgaggcataatacttc

SEQ ID NO: 309976 - DNA, 20 bp, Artificial Sequence
  Description of Artificial Sequence: Synthetic oligonucleotide
  Target: ATXN1; (+) strand; PAM type: YTN; PAM sequence: TTT
tcctgaggcataatacttca

SEQ ID NO: 309977 - DNA, 20 bp, Artificial Sequence
  Description of Artificial Sequence: Synthetic oligonucleotide
  Target: ATXN1; (+) strand; PAM type: YTN; PAM sequence: TTT
cctgaggcataatacttcag

SEQ ID NO: 309978 - DNA, 20 bp, Artificial Sequence
  Description of Artificial Sequence: Synthetic oligonucleotide
  Target: ATXN1; (+) strand; PAM type: YTN; PAM sequence: TTC
ctgaggcataatacttcagt

SEQ ID NO: 309979 - DNA, 20 bp, Artificial Sequence
  Description of Artificial Sequence: Synthetic oligonucleotide
  Target: ATXN1; (+) strand; PAM type: YTN; PAM sequence: CTG
aggcataatacttcagtcac

SEQ ID NO: 309980 - DNA, 20 bp, Artificial Sequence
  Description of Artificial Sequence: Synthetic oligonucleotide
  Target: ATXN1; (+) strand; PAM type: YTN; PAM sequence: CTT
cagtcactcaggtttttgtt

SEQ ID NO: 309981 - DNA, 20 bp, Artificial Sequence
  Description of Artificial Sequence: Synthetic oligonucleotide
  Target: ATXN1; (+) strand; PAM type: YTN; PAM sequence: TTC
agtcactcaggtttttgttt

SEQ ID NO: 309982 - DNA, 20 bp, Artificial Sequence
  Description of Artificial Sequence: Synthetic oligonucleotide
  Target: ATXN1; (+) strand; PAM type: YTN; PAM sequence: CTC
aggtttttgtttatttttac

SEQ ID NO: 309983 - DNA, 20 bp, Artificial Sequence
  Description of Artificial Sequence: Synthetic oligonucleotide
  Target: ATXN1; (+) strand; PAM type: YTN; PAM sequence: TTT
ttgtttatttttactcagac

SEQ ID NO: 309984 - DNA, 20 bp, Artificial Sequence
  Description of Artificial Sequence: Synthetic oligonucleotide
  Target: ATXN1; (+) strand; PAM type: YTN; PAM sequence: TTT
tgtttatttttactcagacc

SEQ ID NO: 309985 - DNA, 20 bp, Artificial Sequence
  Description of Artificial Sequence: Synthetic oligonucleotide
  Target: ATXN1; (+) strand; PAM type: YTN; PAM sequence: TTT
gtttatttttactcagacca

SEQ ID NO: 309986 - DNA, 20 bp, Artificial Sequence
  Description of Artificial Sequence: Synthetic oligonucleotide
  Target: ATXN1; (+) strand; PAM type: YTN; PAM sequence: TTG
tttatttttactcagaccac

SEQ ID NO: 309987 - DNA, 20 bp, Artificial Sequence
  Description of Artificial Sequence: Synthetic oligonucleotide
  Target: ATXN1; (+) strand; PAM type: YTN; PAM sequence: TTT
atttttactcagaccacaaa

SEQ ID NO: 309988 - DNA, 20 bp, Artificial Sequence
  Description of Artificial Sequence: Synthetic oligonucleotide
  Target: ATXN1; (+) strand; PAM type: YTN; PAM sequence: TTA
tttttactcagaccacaaat

SEQ ID NO: 309989 - DNA, 20 bp, Artificial Sequence
  Description of Artificial Sequence: Synthetic oligonucleotide
  Target: ATXN1; (+) strand; PAM type: YTN; PAM sequence: TTT
ttactcagaccacaaataac

SEQ ID NO: 309990 - DNA, 20 bp, Artificial Sequence
  Description of Artificial Sequence: Synthetic oligonucleotide
  Target: ATXN1; (+) strand; PAM type: YTN; PAM sequence: TTT
tactcagaccacaaataacc

SEQ ID NO: 309991 - DNA, 20 bp, Artificial Sequence
  Description of Artificial Sequence: Synthetic oligonucleotide
  Target: ATXN1; (+) strand; PAM type: YTN; PAM sequence: TTT
actcagaccacaaataacca

SEQ ID NO: 309992 - DNA, 20 bp, Artificial Sequence
  Description of Artificial Sequence: Synthetic oligonucleotide
  Target: ATXN1; (+) strand; PAM type: YTN; PAM sequence: TTA
ctcagaccacaaataaccac

SEQ ID NO: 309993 - DNA, 20 bp, Artificial Sequence
  Description of Artificial Sequence: Synthetic oligonucleotide
  Target: ATXN1; (+) strand; PAM type: YTN; PAM sequence: CTC
agaccacaaataaccacatt

SEQ ID NO: 309994 - DNA, 20 bp, Artificial Sequence
  Description of Artificial Sequence: Synthetic oligonucleotide
  Target: ATXN1; (+) strand; PAM type: YTN; PAM sequence: TTT
atgcatgcaattcatcagtt

SEQ ID NO: 309995 - DNA, 20 bp, Artificial Sequence
  Description of Artificial Sequence: Synthetic oligonucleotide
  Target: ATXN1; (+) strand; PAM type: YTN; PAM sequence: TTA
tgcatgcaattcatcagttc

SEQ ID NO: 309996 - DNA, 20 bp, Artificial Sequence
  Description of Artificial Sequence: Synthetic oligonucleotide
  Target: ATXN1; (+) strand; PAM type: YTN; PAM sequence: TTC
atcagttcattttacaacaa

SEQ ID NO: 309997 - DNA, 20 bp, Artificial Sequence
  Description of Artificial Sequence: Synthetic oligonucleotide
  Target: ATXN1; (+) strand; PAM type: YTN; PAM sequence: TTC
attttacaacaatctaaaaa

SEQ ID NO: 309998 - DNA, 20 bp, Artificial Sequence
  Description of Artificial Sequence: Synthetic oligonucleotide
  Target: ATXN1; (+) strand; PAM type: YTN; PAM sequence: TTT
tacaacaatctaaaaaaaaa

SEQ ID NO: 309999 - DNA, 20 bp, Artificial Sequence
  Description of Artificial Sequence: Synthetic oligonucleotide
  Target: ATXN1; (+) strand; PAM type: YTN; PAM sequence: TTT
acaacaatctaaaaaaaaaa

SEQ ID NO: 310000 - DNA, 20 bp, Artificial Sequence
  Description of Artificial Sequence: Synthetic oligonucleotide
  Target: ATXN1; (+) strand; PAM type: YTN; PAM sequence: TTA
caacaatctaaaaaaaaaaa

SEQ ID NO: 310001 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaaaaaccacacat

SEQ ID NO: 310002 - DNA, 20 bp, Artificial Sequence
  Description of Artificial Sequence: Synthetic oligonucleotide
  Target: ATXN1; (+) strand; PAM type: YTN; PAM sequence: TTG
tgataaattcagaatttaaa

SEQ ID NO: 310003 - DNA, 20 bp, Artificial Sequence
  Description of Artificial Sequence: Synthetic oligonucleotide
  Target: ATXN1; (+) strand; PAM type: YTN; PAM sequence: TTC
agaatttaaaattcagcaaa

SEQ ID NO: 310004 - DNA, 20 bp, Artificial Sequence
  Description of Artificial Sequence: Synthetic oligonucleotide
  Target: ATXN1; (+) strand; PAM type: YTN; PAM sequence: TTT
aaaattcagcaaaaacaaat

SEQ ID NO: 310005 - DNA, 20 bp, Artificial Sequence
  Description of Artificial Sequence: Synthetic oligonucleotide
  Target: ATXN1; (+) strand; PAM type: YTN; PAM sequence: TTA
aaattcagcaaaaacaaata

SEQ ID NO: 310006 - DNA, 20 bp, Artificial Sequence
  Description of Artificial Sequence: Synthetic oligonucleotide
  Target: ATXN1; (+) strand; PAM type: YTN; PAM sequence: TTC
agcaaaaacaaataaaaggc

SEQ ID NO: 310007 - DNA, 20 bp, Artificial Sequence
  Description of Artificial Sequence: Synthetic oligonucleotide
  Target: ATXN1; (+) strand; PAM type: YTN; PAM sequence: CTC
cttggctttgcagagccgta

SEQ ID NO: 310008 - DNA, 20 bp, Artificial Sequence
  Description of Artificial Sequence: Synthetic oligonucleotide
  Target: ATXN1; (+) strand; PAM type: YTN; PAM sequence: CTT
ggctttgcagagccgtagat

SEQ ID NO: 310009 - DNA, 20 bp, Artificial Sequence
  Description of Artificial Sequence: Synthetic oligonucleotide
  Target: ATXN1; (+) strand; PAM type: YTN; PAM sequence: TTG
gctttgcagagccgtagatg

SEQ ID NO: 310010 - DNA, 20 bp, Artificial Sequence
  Description of Artificial Sequence: Synthetic oligonucleotide
  Target: ATXN1; (+) strand; PAM type: YTN; PAM sequence: CTT
tgcagagccgtagatgtcta

SEQ ID NO: 310011 - DNA, 20 bp, Artificial Sequence
  Description of Artificial Sequence: Synthetic oligonucleotide
  Target: ATXN1; (+) strand; PAM type: YTN; PAM sequence: TTT
gcagagccgtagatgtctac

SEQ ID NO: 310012 - DNA, 20 bp, Artificial Sequence
  Description of Artificial Sequence: Synthetic oligonucleotide
  Target: ATXN1; (+) strand; PAM type: YTN; PAM sequence: TTG
cagagccgtagatgtctaca

SEQ ID NO: 310013 - DNA, 20 bp, Artificial Sequence
  Description of Artificial Sequence: Synthetic oligonucleotide
  Target: ATXN1; (+) strand; PAM type: YTN; PAM sequence: CTA
cagggtgggtccaaagacca

SEQ ID NO: 310014 - DNA, 20 bp, Artificial Sequence
  Description of Artificial Sequence: Synthetic oligonucleotide
  Target: ATXN1; (+) strand; PAM type: YTN; PAM sequence: TTT
acatatttctagtcatgtat

SEQ ID NO: 310015 - DNA, 20 bp, Artificial Sequence
  Description of Artificial Sequence: Synthetic oligonucleotide
  Target: ATXN1; (+) strand; PAM type: YTN; PAM sequence: TTA
catatttctagtcatgtatg

SEQ ID NO: 310016 - DNA, 20 bp, Artificial Sequence
  Description of Artificial Sequence: Synthetic oligonucleotide
  Target: ATXN1; (+) strand; PAM type: YTN; PAM sequence: TTT
ctagtcatgtatggttcagg

SEQ ID NO: 310017 - DNA, 20 bp, Artificial Sequence
  Description of Artificial Sequence: Synthetic oligonucleotide
  Target: ATXN1; (+) strand; PAM type: YTN; PAM sequence: TTC
tagtcatgtatggttcagga

SEQ ID NO: 310018 - DNA, 20 bp, Artificial Sequence
  Description of Artificial Sequence: Synthetic oligonucleotide
  Target: ATXN1; (+) strand; PAM type: YTN; PAM sequence: CTA
gtcatgtatggttcaggagc

SEQ ID NO: 310019 - DNA, 20 bp, Artificial Sequence
  Description of Artificial Sequence: Synthetic oligonucleotide
  Target: ATXN1; (+) strand; PAM type: YTN; PAM sequence: TTC
aggagcaaccatcataaaac

SEQ ID NO: 310020 - DNA, 20 bp, Artificial Sequence
  Description of Artificial Sequence: Synthetic oligonucleotide
  Target: ATXN1; (+) strand; PAM type: YTN; PAM sequence: CTG
ttgagggataagttacttga

SEQ ID NO: 310021 - DNA, 20 bp, Artificial Sequence
  Description of Artificial Sequence: Synthetic oligonucleotide
  Target: ATXN1; (+) strand; PAM type: YTN; PAM sequence: TTG
agggataagttacttgatag

SEQ ID NO: 310022 - DNA, 20 bp, Artificial Sequence
  Description of Artificial Sequence: Synthetic oligonucleotide
  Target: ATXN1; (+) strand; PAM type: YTN; PAM sequence: TTA
cttgatagcatctgttaaaa

SEQ ID NO: 310023 - DNA, 20 bp, Artificial Sequence
  Description of Artificial Sequence: Synthetic oligonucleotide
  Target: ATXN1; (+) strand; PAM type: YTN; PAM sequence: CTT
gatagcatctgttaaaagat

SEQ ID NO: 310024 - DNA, 20 bp, Artificial Sequence
  Description of Artificial Sequence: Synthetic oligonucleotide
  Target: ATXN1; (+) strand; PAM type: YTN; PAM sequence: TTG
atagcatctgttaaaagata

SEQ ID NO: 310025 - DNA, 20 bp, Artificial Sequence
  Description of Artificial Sequence: Synthetic oligonucleotide
  Target: ATXN1; (+) strand; PAM type: YTN; PAM sequence: CTG
ttaaaagatacaaaccatac

SEQ ID NO: 310026 - DNA, 20 bp, Artificial Sequence
  Description of Artificial Sequence: Synthetic oligonucleotide
  Target: ATXN1; (+) strand; PAM type: YTN; PAM sequence: TTA
aaagatacaaaccatacacc

SEQ ID NO: 310027 - DNA, 20 bp, Artificial Sequence
  Description of Artificial Sequence: Synthetic oligonucleotide
  Target: ATXN1; (+) strand; PAM type: YTN; PAM sequence: CTA
ttctacccacagtatatcta

SEQ ID NO: 310028 - DNA, 20 bp, Artificial Sequence
  Description of Artificial Sequence: Synthetic oligonucleotide
  Target: ATXN1; (+) strand; PAM type: YTN; PAM sequence: TTC
tacccacagtatatctacta

SEQ ID NO: 310029 - DNA, 20 bp, Artificial Sequence
  Description of Artificial Sequence: Synthetic oligonucleotide
  Target: ATXN1; (+) strand; PAM type: YTN; PAM sequence: CTA
cccacagtatatctactatt

SEQ ID NO: 310030 - DNA, 20 bp, Artificial Sequence
  Description of Artificial Sequence: Synthetic oligonucleotide
  Target: ATXN1; (+) strand; PAM type: YTN; PAM sequence: CTA
ctattttactccagtccatc

SEQ ID NO: 310031 - DNA, 20 bp, Artificial Sequence
  Description of Artificial Sequence: Synthetic oligonucleotide
  Target: ATXN1; (+) strand; PAM type: YTN; PAM sequence: CTA
ttttactccagtccatcctc

SEQ ID NO: 310032 - DNA, 20 bp, Artificial Sequence
  Description of Artificial Sequence: Synthetic oligonucleotide
  Target: ATXN1; (+) strand; PAM type: YTN; PAM sequence: TTT
tactccagtccatcctcaca

SEQ ID NO: 310033 - DNA, 20 bp, Artificial Sequence
  Description of Artificial Sequence: Synthetic oligonucleotide
  Target: ATXN1; (+) strand; PAM type: YTN; PAM sequence: TTT
actccagtccatcctcacag

SEQ ID NO: 310034 - DNA, 20 bp, Artificial Sequence
  Description of Artificial Sequence: Synthetic oligonucleotide
  Target: ATXN1; (+) strand; PAM type: YTN; PAM sequence: TTA
ctccagtccatcctcacagc

SEQ ID NO: 310035 - DNA, 20 bp, Artificial Sequence
  Description of Artificial Sequence: Synthetic oligonucleotide
  Target: ATXN1; (+) strand; PAM type: YTN; PAM sequence: CTC
cagtccatcctcacagcagc

SEQ ID NO: 310036 - DNA, 20 bp, Artificial Sequence
  Description of Artificial Sequence: Synthetic oligonucleotide
  Target: ATXN1; (+) strand; PAM type: YTN; PAM sequence: CTC
acagcagccctataagaaag

SEQ ID NO: 310037 - DNA, 20 bp, Artificial Sequence
  Description of Artificial Sequence: Synthetic oligonucleotide
  Target: ATXN1; (+) strand; PAM type: YTN; PAM sequence: CTA
taagaaagttctaatattac

SEQ ID NO: 310038 - DNA, 20 bp, Artificial Sequence
  Description of Artificial Sequence: Synthetic oligonucleotide
  Target: ATXN1; (+) strand; PAM type: YTN; PAM sequence: TTC
taatattacctccatcttat

SEQ ID NO: 310039 - DNA, 20 bp, Artificial Sequence
  Description of Artificial Sequence: Synthetic oligonucleotide
  Target: ATXN1; (+) strand; PAM type: YTN; PAM sequence: CTA
atattacctccatcttatac

SEQ ID NO: 310040 - DNA, 20 bp, Artificial Sequence
  Description of Artificial Sequence: Synthetic oligonucleotide
  Target: ATXN1; (+) strand; PAM type: YTN; PAM sequence: TTA
cctccatcttatacatgaat

SEQ ID NO: 310041 - DNA, 20 bp, Artificial Sequence
  Description of Artificial Sequence: Synthetic oligonucleotide
  Target: ATXN1; (+) strand; PAM type: YTN; PAM sequence: CTC
catcttatacatgaataaac

SEQ ID NO: 310042 - DNA, 20 bp, Artificial Sequence
  Description of Artificial Sequence: Synthetic oligonucleotide
  Target: ATXN1; (+) strand; PAM type: YTN; PAM sequence: CTT
atacatgaataaactgaggc

SEQ ID NO: 310043 - DNA, 20 bp, Artificial Sequence
  Description of Artificial Sequence: Synthetic oligonucleotide
  Target: ATXN1; (+) strand; PAM type: YTN; PAM sequence: TTA
tacatgaataaactgaggca

SEQ ID NO: 310044 - DNA, 20 bp, Artificial Sequence
  Description of Artificial Sequence: Synthetic oligonucleotide
  Target: ATXN1; (+) strand; PAM type: YTN; PAM sequence: CTG
aggcattgaaaggacatagg

SEQ ID NO: 310045 - DNA, 20 bp, Artificial Sequence
  Description of Artificial Sequence: Synthetic oligonucleotide
  Target: ATXN1; (+) strand; PAM type: YTN; PAM sequence: TTG
aaaggacataggactactca

SEQ ID NO: 310046 - DNA, 20 bp, Artificial Sequence
  Description of Artificial Sequence: Synthetic oligonucleotide
  Target: ATXN1; (+) strand; PAM type: YTN; PAM sequence: CTA
ctcaaggtcatagtggcagc

SEQ ID NO: 310047 - DNA, 20 bp, Artificial Sequence
  Description of Artificial Sequence: Synthetic oligonucleotide
  Target: ATXN1; (+) strand; PAM type: YTN; PAM sequence: CTC
aaggtcatagtggcagctcc

SEQ ID NO: 310048 - DNA, 20 bp, Artificial Sequence
  Description of Artificial Sequence: Synthetic oligonucleotide
  Target: ATXN1; (+) strand; PAM type: YTN; PAM sequence: CTC
cagatcttaagtccagatgg

SEQ ID NO: 310049 - DNA, 20 bp, Artificial Sequence
  Description of Artificial Sequence: Synthetic oligonucleotide
  Target: ATXN1; (+) strand; PAM type: YTN; PAM sequence: CTT
aagtccagatgggttgatta

SEQ ID NO: 310050 - DNA, 20 bp, Artificial Sequence
  Description of Artificial Sequence: Synthetic oligonucleotide
  Target: ATXN1; (+) strand; PAM type: YTN; PAM sequence: TTA
agtccagatgggttgattac

SEQ ID NO: 310051 - DNA, 20 bp, Artificial Sequence
  Description of Artificial Sequence: Synthetic oligonucleotide
  Target: ATXN1; (+) strand; PAM type: YTN; PAM sequence: TTG
attacggagctccatgctct

SEQ ID NO: 310052 - DNA, 20 bp, Artificial Sequence
  Description of Artificial Sequence: Synthetic oligonucleotide
  Target: ATXN1; (+) strand; PAM type: YTN; PAM sequence: TTA
cggagctccatgctcttatc

SEQ ID NO: 310053 - DNA, 20 bp, Artificial Sequence
  Description of Artificial Sequence: Synthetic oligonucleotide
  Target: ATXN1; (+) strand; PAM type: YTN; PAM sequence: CTC
catgctcttatctaagatgc

SEQ ID NO: 310054 - DNA, 20 bp, Artificial Sequence
  Description of Artificial Sequence: Synthetic oligonucleotide
  Target: ATXN1; (+) strand; PAM type: YTN; PAM sequence: CTC
ttatctaagatgccagagaa

SEQ ID NO: 310055 - DNA, 20 bp, Artificial Sequence
  Description of Artificial Sequence: Synthetic oligonucleotide
  Target: ATXN1; (+) strand; PAM type: YTN; PAM sequence: CTT
atctaagatgccagagaatt

SEQ ID NO: 310056 - DNA, 20 bp, Artificial Sequence
  Description of Artificial Sequence: Synthetic oligonucleotide
  Target: ATXN1; (+) strand; PAM type: YTN; PAM sequence: TTA
tctaagatgccagagaattt

SEQ ID NO: 310057 - DNA, 20 bp, Artificial Sequence
  Description of Artificial Sequence: Synthetic oligonucleotide
  Target: ATXN1; (+) strand; PAM type: YTN; PAM sequence: CTA
agatgccagagaatttatat

SEQ ID NO: 310058 - DNA, 20 bp, Artificial Sequence
  Description of Artificial Sequence: Synthetic oligonucleotide
  Target: ATXN1; (+) strand; PAM type: YTN; PAM sequence: TTT
atatgtaacttaaaaattgg

SEQ ID NO: 310059 - DNA, 20 bp, Artificial Sequence
  Description of Artificial Sequence: Synthetic oligonucleotide
  Target: ATXN1; (+) strand; PAM type: YTN; PAM sequence: TTA
tatgtaacttaaaaattggc

SEQ ID NO: 310060 - DNA, 20 bp, Artificial Sequence
  Description of Artificial Sequence: Synthetic oligonucleotide
  Target: ATXN1; (+) strand; PAM type: YTN; PAM sequence: CTT
aaaaattggctcttacggta

SEQ ID NO: 310061 - DNA, 20 bp, Artificial Sequence
  Description of Artificial Sequence: Synthetic oligonucleotide
  Target: ATXN1; (+) strand; PAM type: YTN; PAM sequence: TTA
aaaattggctcttacggtaa

SEQ ID NO: 310062 - DNA, 20 bp, Artificial Sequence
  Description of Artificial Sequence: Synthetic oligonucleotide
  Target: ATXN1; (+) strand; PAM type: YTN; PAM sequence: TTG
gctcttacggtaaagaggca

SEQ ID NO: 310063 - DNA, 20 bp, Artificial Sequence
  Description of Artificial Sequence: Synthetic oligonucleotide
  Target: ATXN1; (+) strand; PAM type: YTN; PAM sequence: CTC
ttacggtaaagaggcagctc

SEQ ID NO: 310064 - DNA, 20 bp, Artificial Sequence
  Description of Artificial Sequence: Synthetic oligonucleotide
  Target: ATXN1; (+) strand; PAM type: YTN; PAM sequence: CTT
acggtaaagaggcagctctt

SEQ ID NO: 310065 - DNA, 20 bp, Artificial Sequence
  Description of Artificial Sequence: Synthetic oligonucleotide
  Target: ATXN1; (+) strand; PAM type: YTN; PAM sequence: TTA
cggtaaagaggcagctcttt

SEQ ID NO: 310066 - DNA, 20 bp, Artificial Sequence
  Description of Artificial Sequence: Synthetic oligonucleotide
  Target: ATXN1; (+) strand; PAM type: YTN; PAM sequence: CTC
tttcttcaaagaaatctggt

SEQ ID NO: 310067 - DNA, 20 bp, Artificial Sequence
  Description of Artificial Sequence: Synthetic oligonucleotide
  Target: ATXN1; (+) strand; PAM type: YTN; PAM sequence: CTT
tcttcaaagaaatctggtca

SEQ ID NO: 310068 - DNA, 20 bp, Artificial Sequence
  Description of Artificial Sequence: Synthetic oligonucleotide
  Target: ATXN1; (+) strand; PAM type: YTN; PAM sequence: TTT
cttcaaagaaatctggtcaa

SEQ ID NO: 310069 - DNA, 20 bp, Artificial Sequence
  Description of Artificial Sequence: Synthetic oligonucleotide
  Target: ATXN1; (+) strand; PAM type: YTN; PAM sequence: TTC
ttcaaagaaatctggtcaat

SEQ ID NO: 310070 - DNA, 20 bp, Artificial Sequence
  Description of Artificial Sequence: Synthetic oligonucleotide
  Target: ATXN1; (+) strand; PAM type: YTN; PAM sequence: CTT
caaagaaatctggtcaatta

SEQ ID NO: 310071 - DNA, 20 bp, Artificial Sequence
  Description of Artificial Sequence: Synthetic oligonucleotide
  Target: ATXN1; (+) strand; PAM type: YTN; PAM sequence: TTC
aaagaaatctggtcaattat

SEQ ID NO: 310072 - DNA, 20 bp, Artificial Sequence
  Description of Artificial Sequence: Synthetic oligonucleotide
  Target: ATXN1; (+) strand; PAM type: YTN; PAM sequence: CTG
gtcaattattgtttaaatga

SEQ ID NO: 310073 - DNA, 20 bp, Artificial Sequence
  Description of Artificial Sequence: Synthetic oligonucleotide
  Target: ATXN1; (+) strand; PAM type: YTN; PAM sequence: TTA
ttgtttaaatgaacctgtta

SEQ ID NO: 310074 - DNA, 20 bp, Artificial Sequence
  Description of Artificial Sequence: Synthetic oligonucleotide
  Target: ATXN1; (+) strand; PAM type: YTN; PAM sequence: TTG
tttaaatgaacctgttataa

SEQ ID NO: 310075 - DNA, 20 bp, Artificial Sequence
  Description of Artificial Sequence: Synthetic oligonucleotide
  Target: ATXN1; (+) strand; PAM type: YTN; PAM sequence: TTT
aaatgaacctgttataaagc

SEQ ID NO: 310076 - DNA, 20 bp, Artificial Sequence
  Description of Artificial Sequence: Synthetic oligonucleotide
  Target: ATXN1; (+) strand; PAM type: YTN; PAM sequence: TTA
aatgaacctgttataaagca

SEQ ID NO: 310077 - DNA, 20 bp, Artificial Sequence
  Description of Artificial Sequence: Synthetic oligonucleotide
  Target: ATXN1; (+) strand; PAM type: YTN; PAM sequence: CTG
ttataaagcaaatatccatc

SEQ ID NO: 310078 - DNA, 20 bp, Artificial Sequence
  Description of Artificial Sequence: Synthetic oligonucleotide
  Target: ATXN1; (+) strand; PAM type: YTN; PAM sequence: TTA
taaagcaaatatccatctac

SEQ ID NO: 310079 - DNA, 20 bp, Artificial Sequence
  Description of Artificial Sequence: Synthetic oligonucleotide
  Target: ATXN1; (+) strand; PAM type: YTN; PAM sequence: CTA
cctcttgaaaaatgagtttt

SEQ ID NO: 310080 - DNA, 20 bp, Artificial Sequence
  Description of Artificial Sequence: Synthetic oligonucleotide
  Target: ATXN1; (+) strand; PAM type: YTN; PAM sequence: CTC
ttgaaaaatgagttttgaaa

SEQ ID NO: 310081 - DNA, 20 bp, Artificial Sequence
  Description of Artificial Sequence: Synthetic oligonucleotide
  Target: ATXN1; (+) strand; PAM type: YTN; PAM sequence: CTT
gaaaaatgagttttgaaaat

SEQ ID NO: 310082 - DNA, 20 bp, Artificial Sequence
  Description of Artificial Sequence: Synthetic oligonucleotide
  Target: ATXN1; (+) strand; PAM type: YTN; PAM sequence: TTG
aaaaatgagttttgaaaatt

SEQ ID NO: 310083 - DNA, 20 bp, Artificial Sequence
  Description of Artificial Sequence: Synthetic oligonucleotide
  Target: ATXN1; (+) strand; PAM type: YTN; PAM sequence: TTT
tgaaaattcaaattttcaaa

SEQ ID NO: 310084 - DNA, 20 bp, Artificial Sequence
  Description of Artificial Sequence: Synthetic oligonucleotide
  Target: ATXN1; (+) strand; PAM type: YTN; PAM sequence: TTT
gaaaattcaaattttcaaat

SEQ ID NO: 310085 - DNA, 20 bp, Artificial Sequence
  Description of Artificial Sequence: Synthetic oligonucleotide
  Target: ATXN1; (+) strand; PAM type: YTN; PAM sequence: TTG
aaaattcaaattttcaaatg

SEQ ID NO: 310086 - DNA, 20 bp, Artificial Sequence
  Description of Artificial Sequence: Synthetic oligonucleotide
  Target: ATXN1; (+) strand; PAM type: YTN; PAM sequence: TTC
aaattttcaaatgggagatt

SEQ ID NO: 310087 - DNA, 20 bp, Artificial Sequence
  Description of Artificial Sequence: Synthetic oligonucleotide
  Target: ATXN1; (+) strand; PAM type: YTN; PAM sequence: TTT
tcaaatgggagatttgctaa

SEQ ID NO: 310088 - DNA, 20 bp, Artificial Sequence
  Description of Artificial Sequence: Synthetic oligonucleotide
  Target: ATXN1; (+) strand; PAM type: YTN; PAM sequence: TTT
caaatgggagatttgctaaa

SEQ ID NO: 310089 - DNA, 20 bp, Artificial Sequence
  Description of Artificial Sequence: Synthetic oligonucleotide
  Target: ATXN1; (+) strand; PAM type: YTN; PAM sequence: TTC
aaatgggagatttgctaaaa

SEQ ID NO: 310090 - DNA, 20 bp, Artificial Sequence
  Description of Artificial Sequence: Synthetic oligonucleotide
  Target: ATXN1; (+) strand; PAM type: YTN; PAM sequence: TTT
gctaaaagtagaatgagctt

SEQ ID NO: 310091 - DNA, 20 bp, Artificial Sequence
  Description of Artificial Sequence: Synthetic oligonucleotide
  Target: ATXN1; (+) strand; PAM type: YTN; PAM sequence: TTG
ctaaaagtagaatgagcttc

SEQ ID NO: 310092 - DNA, 20 bp, Artificial Sequence
  Description of Artificial Sequence: Synthetic oligonucleotide
  Target: ATXN1; (+) strand; PAM type: YTN; PAM sequence: CTA
aaagtagaatgagcttctca

SEQ ID NO: 310093 - DNA, 20 bp, Artificial Sequence
  Description of Artificial Sequence: Synthetic oligonucleotide
  Target: ATXN1; (+) strand; PAM type: YTN; PAM sequence: CTT
ctcaccaactaagtctacag

SEQ ID NO: 310094 - DNA, 20 bp, Artificial Sequence
  Description of Artificial Sequence: Synthetic oligonucleotide
  Target: ATXN1; (+) strand; PAM type: YTN; PAM sequence: TTC
tcaccaactaagtctacaga

SEQ ID NO: 310095 - DNA, 20 bp, Artificial Sequence
  Description of Artificial Sequence: Synthetic oligonucleotide
  Target: ATXN1; (+) strand; PAM type: YTN; PAM sequence: CTC
accaactaagtctacagaac

SEQ ID NO: 310096 - DNA, 20 bp, Artificial Sequence
  Description of Artificial Sequence: Synthetic oligonucleotide
  Target: ATXN1; (+) strand; PAM type: YTN; PAM sequence: CTA
agtctacagaacataactta

SEQ ID NO: 310097 - DNA, 20 bp, Artificial Sequence
  Description of Artificial Sequence: Synthetic oligonucleotide
  Target: ATXN1; (+) strand; PAM type: YTN; PAM sequence: CTA
cagaacataacttaggaaga

SEQ ID NO: 310098 - DNA, 20 bp, Artificial Sequence
  Description of Artificial Sequence: Synthetic oligonucleotide
  Target: ATXN1; (+) strand; PAM type: YTN; PAM sequence: CTT
aggaagagttgctggaagac

SEQ ID NO: 310099 - DNA, 20 bp, Artificial Sequence
  Description of Artificial Sequence: Synthetic oligonucleotide
  Target: ATXN1; (+) strand; PAM type: YTN; PAM sequence: TTA
ggaagagttgctggaagacc

SEQ ID NO: 310100 - DNA, 20 bp, Artificial Sequence
  Description of Artificial Sequence: Synthetic oligonucleotide
  Target: ATXN1; (+) strand; PAM type: YTN; PAM sequence: TTG
ctggaagaccggccgaccca

SEQ ID NO: 310101 - DNA, 20 bp, Artificial Sequence
  Description of Artificial Sequence: Synthetic oligonucleotide
  Target: ATXN1; (+) strand; PAM type: YTN; PAM sequence: CTG
gaagaccggccgacccaggg

SEQ ID NO: 310102 - DNA, 20 bp, Artificial Sequence
  Description of Artificial Sequence: Synthetic oligonucleotide
  Target: ATXN1; (+) strand; PAM type: YTN; PAM sequence: TTC
ccaaacctgtggagcatcag

SEQ ID NO: 310103 - DNA, 20 bp, Artificial Sequence
  Description of Artificial Sequence: Synthetic oligonucleotide
  Target: ATXN1; (+) strand; PAM type: YTN; PAM sequence: CTG
tggagcatcagtgcctagac

SEQ ID NO: 310104 - DNA, 20 bp, Artificial Sequence
  Description of Artificial Sequence: Synthetic oligonucleotide
  Target: ATXN1; (+) strand; PAM type: YTN; PAM sequence: CTA
gacagatcaatgattccagc

SEQ ID NO: 310105 - DNA, 20 bp, Artificial Sequence
  Description of Artificial Sequence: Synthetic oligonucleotide
  Target: ATXN1; (+) strand; PAM type: YTN; PAM sequence: TTC
cagcaggaaacattctgatt

SEQ ID NO: 310106 - DNA, 20 bp, Artificial Sequence
  Description of Artificial Sequence: Synthetic oligonucleotide
  Target: ATXN1; (+) strand; PAM type: YTN; PAM sequence: TTC
tgattcatcaagtctagggt

SEQ ID NO: 310107 - DNA, 20 bp, Artificial Sequence
  Description of Artificial Sequence: Synthetic oligonucleotide
  Target: ATXN1; (+) strand; PAM type: YTN; PAM sequence: CTG
attcatcaagtctagggtgg

SEQ ID NO: 310108 - DNA, 20 bp, Artificial Sequence
  Description of Artificial Sequence: Synthetic oligonucleotide
  Target: ATXN1; (+) strand; PAM type: YTN; PAM sequence: TTC
atcaagtctagggtggagct

SEQ ID NO: 310109 - DNA, 20 bp, Artificial Sequence
  Description of Artificial Sequence: Synthetic oligonucleotide
  Target: ATXN1; (+) strand; PAM type: YTN; PAM sequence: CTA
gggtggagctccaaattcta

SEQ ID NO: 310110 - DNA, 20 bp, Artificial Sequence
  Description of Artificial Sequence: Synthetic oligonucleotide
  Target: ATXN1; (+) strand; PAM type: YTN; PAM sequence: CTC
caaattctatttttttaagc

SEQ ID NO: 310111 - DNA, 20 bp, Artificial Sequence
  Description of Artificial Sequence: Synthetic oligonucleotide
  Target: ATXN1; (+) strand; PAM type: YTN; PAM sequence: TTC
tatttttttaagctctccag

SEQ ID NO: 310112 - DNA, 20 bp, Artificial Sequence
  Description of Artificial Sequence: Synthetic oligonucleotide
  Target: ATXN1; (+) strand; PAM type: YTN; PAM sequence: CTA
tttttttaagctctccaggt

SEQ ID NO: 310113 - DNA, 20 bp, Artificial Sequence
  Description of Artificial Sequence: Synthetic oligonucleotide
  Target: ATXN1; (+) strand; PAM type: YTN; PAM sequence: TTT
ttttaagctctccaggtgat

SEQ ID NO: 310114 - DNA, 20 bp, Artificial Sequence
  Description of Artificial Sequence: Synthetic oligonucleotide
  Target: ATXN1; (+) strand; PAM type: YTN; PAM sequence: TTT
tttaagctctccaggtgatt

SEQ ID NO: 310115 - DNA, 20 bp, Artificial Sequence
  Description of Artificial Sequence: Synthetic oligonucleotide
  Target: ATXN1; (+) strand; PAM type: YTN; PAM sequence: TTT
ttaagctctccaggtgattc

SEQ ID NO: 310116 - DNA, 20 bp, Artificial Sequence
  Description of Artificial Sequence: Synthetic oligonucleotide
  Target: ATXN1; (+) strand; PAM type: YTN; PAM sequence: TTT
taagctctccaggtgattct

SEQ ID NO: 310117 - DNA, 20 bp, Artificial Sequence
  Description of Artificial Sequence: Synthetic oligonucleotide
  Target: ATXN1; (+) strand; PAM type: YTN; PAM sequence: TTT
aagctctccaggtgattctg

SEQ ID NO: 310118 - DNA, 20 bp, Artificial Sequence
  Description of Artificial Sequence: Synthetic oligonucleotide
  Target: ATXN1; (+) strand; PAM type: YTN; PAM sequence: TTA
agctctccaggtgattctgt

SEQ ID NO: 310119 - DNA, 20 bp, Artificial Sequence
  Description of Artificial Sequence: Synthetic oligonucleotide
  Target: ATXN1; (+) strand; PAM type: YTN; PAM sequence: CTC
tccaggtgattctgttgcct

SEQ ID NO: 310120 - DNA, 20 bp, Artificial Sequence
  Description of Artificial Sequence: Synthetic oligonucleotide
  Target: ATXN1; (+) strand; PAM type: YTN; PAM sequence: CTC
caggtgattctgttgcctag

SEQ ID NO: 310121 - DNA, 20 bp, Artificial Sequence
  Description of Artificial Sequence: Synthetic oligonucleotide
  Target: ATXN1; (+) strand; PAM type: YTN; PAM sequence: TTC
tgttgcctagccaggcttgg

SEQ ID NO: 310122 - DNA, 20 bp, Artificial Sequence
  Description of Artificial Sequence: Synthetic oligonucleotide
  Target: ATXN1; (+) strand; PAM type: YTN; PAM sequence: CTG
ttgcctagccaggcttggga

SEQ ID NO: 310123 - DNA, 20 bp, Artificial Sequence
  Description of Artificial Sequence: Synthetic oligonucleotide
  Target: ATXN1; (+) strand; PAM type: YTN; PAM sequence: TTG
cctagccaggcttgggaacc

SEQ ID NO: 310124 - DNA, 20 bp, Artificial Sequence
  Description of Artificial Sequence: Synthetic oligonucleotide
  Target: ATXN1; (+) strand; PAM type: YTN; PAM sequence: CTA
gccaggcttgggaacctcta

SEQ ID NO: 310125 - DNA, 20 bp, Artificial Sequence
  Description of Artificial Sequence: Synthetic oligonucleotide
  Target: ATXN1; (+) strand; PAM type: YTN; PAM sequence: CTT
gggaacctctaatctagtct

SEQ ID NO: 310126 - DNA, 20 bp, Artificial Sequence
  Description of Artificial Sequence: Synthetic oligonucleotide
  Target: ATXN1; (+) strand; PAM type: YTN; PAM sequence: TTG
ggaacctctaatctagtctg

SEQ ID NO: 310127 - DNA, 20 bp, Artificial Sequence
  Description of Artificial Sequence: Synthetic oligonucleotide
  Target: ATXN1; (+) strand; PAM type: YTN; PAM sequence: CTC
taatctagtctgtcttcaca

SEQ ID NO: 310128 - DNA, 20 bp, Artificial Sequence
  Description of Artificial Sequence: Synthetic oligonucleotide
  Target: ATXN1; (+) strand; PAM type: YTN; PAM sequence: CTA
atctagtctgtcttcacagt

SEQ ID NO: 310129 - DNA, 20 bp, Artificial Sequence
  Description of Artificial Sequence: Synthetic oligonucleotide
  Target: ATXN1; (+) strand; PAM type: YTN; PAM sequence: CTA
gtctgtcttcacagtttcaa

SEQ ID NO: 310130 - DNA, 20 bp, Artificial Sequence
  Description of Artificial Sequence: Synthetic oligonucleotide
  Target: ATXN1; (+) strand; PAM type: YTN; PAM sequence: CTG
tcttcacagtttcaagcagg

SEQ ID NO: 310131 - DNA, 20 bp, Artificial Sequence
  Description of Artificial Sequence: Synthetic oligonucleotide
  Target: ATXN1; (+) strand; PAM type: YTN; PAM sequence: CTT
cacagtttcaagcaggtcca

SEQ ID NO: 310132 - DNA, 20 bp, Artificial Sequence
  Description of Artificial Sequence: Synthetic oligonucleotide
  Target: ATXN1; (+) strand; PAM type: YTN; PAM sequence: TTC
acagtttcaagcaggtccat

SEQ ID NO: 310133 - DNA, 20 bp, Artificial Sequence
  Description of Artificial Sequence: Synthetic oligonucleotide
  Target: ATXN1; (+) strand; PAM type: YTN; PAM sequence: TTT
caagcaggtccatttccaag

SEQ ID NO: 310134 - DNA, 20 bp, Artificial Sequence
  Description of Artificial Sequence: Synthetic oligonucleotide
  Target: ATXN1; (+) strand; PAM type: YTN; PAM sequence: TTC
aagcaggtccatttccaagg

SEQ ID NO: 310135 - DNA, 20 bp, Artificial Sequence
  Description of Artificial Sequence: Synthetic oligonucleotide
  Target: ATXN1; (+) strand; PAM type: YTN; PAM sequence: TTT
ccaaggcaaatagaaattga

SEQ ID NO: 310136 - DNA, 20 bp, Artificial Sequence
  Description of Artificial Sequence: Synthetic oligonucleotide
  Target: ATXN1; (+) strand; PAM type: YTN; PAM sequence: TTC
caaggcaaatagaaattgat

SEQ ID NO: 310137 - DNA, 20 bp, Artificial Sequence
  Description of Artificial Sequence: Synthetic oligonucleotide
  Target: ATXN1; (+) strand; PAM type: YTN; PAM sequence: TTG
atcccctattttctatttca

SEQ ID NO: 310138 - DNA, 20 bp, Artificial Sequence
  Description of Artificial Sequence: Synthetic oligonucleotide
  Target: ATXN1; (+) strand; PAM type: YTN; PAM sequence: CTA
ttttctatttcacaatctcc

SEQ ID NO: 310139 - DNA, 20 bp, Artificial Sequence
  Description of Artificial Sequence: Synthetic oligonucleotide
  Target: ATXN1; (+) strand; PAM type: YTN; PAM sequence: TTT
tctatttcacaatctccctt

SEQ ID NO: 310140 - DNA, 20 bp, Artificial Sequence
  Description of Artificial Sequence: Synthetic oligonucleotide
  Target: ATXN1; (+) strand; PAM type: YTN; PAM sequence: TTT
ctatttcacaatctcccttg

SEQ ID NO: 310141 - DNA, 20 bp, Artificial Sequence
  Description of Artificial Sequence: Synthetic oligonucleotide
  Target: ATXN1; (+) strand; PAM type: YTN; PAM sequence: TTC
tatttcacaatctcccttgg

SEQ ID NO: 310142 - DNA, 20 bp, Artificial Sequence
  Description of Artificial Sequence: Synthetic oligonucleotide
  Target: ATXN1; (+) strand; PAM type: YTN; PAM sequence: CTA
tttcacaatctcccttggtt

SEQ ID NO: 310143 - DNA, 20 bp, Artificial Sequence
  Description of Artificial Sequence: Synthetic oligonucleotide
  Target: ATXN1; (+) strand; PAM type: YTN; PAM sequence: TTT
cacaatctcccttggttaca

SEQ ID NO: 310144 - DNA, 20 bp, Artificial Sequence
  Description of Artificial Sequence: Synthetic oligonucleotide
  Target: ATXN1; (+) strand; PAM type: YTN; PAM sequence: TTC
acaatctcccttggttacat

SEQ ID NO: 310145 - DNA, 20 bp, Artificial Sequence
  Description of Artificial Sequence: Synthetic oligonucleotide
  Target: ATXN1; (+) strand; PAM type: YTN; PAM sequence: CTC
ccttggttacatacactcaa

SEQ ID NO: 310146 - DNA, 20 bp, Artificial Sequence
  Description of Artificial Sequence: Synthetic oligonucleotide
  Target: ATXN1; (+) strand; PAM type: YTN; PAM sequence: CTT
ggttacatacactcaaaccc

SEQ ID NO: 310147 - DNA, 20 bp, Artificial Sequence
  Description of Artificial Sequence: Synthetic oligonucleotide
  Target: ATXN1; (+) strand; PAM type: YTN; PAM sequence: TTG
gttacatacactcaaaccct

SEQ ID NO: 310148 - DNA, 20 bp, Artificial Sequence
  Description of Artificial Sequence: Synthetic oligonucleotide
  Target: ATXN1; (+) strand; PAM type: YTN; PAM sequence: TTA
catacactcaaacccttgtg

SEQ ID NO: 310149 - DNA, 20 bp, Artificial Sequence
  Description of Artificial Sequence: Synthetic oligonucleotide
  Target: ATXN1; (+) strand; PAM type: YTN; PAM sequence: CTC
aaacccttgtgttcccaagc

SEQ ID NO: 310150 - DNA, 20 bp, Artificial Sequence
  Description of Artificial Sequence: Synthetic oligonucleotide
  Target: ATXN1; (+) strand; PAM type: YTN; PAM sequence: CTT
gtgttcccaagcccttactg

SEQ ID NO: 310151 - DNA, 20 bp, Artificial Sequence
  Description of Artificial Sequence: Synthetic oligonucleotide
  Target: ATXN1; (+) strand; PAM type: YTN; PAM sequence: TTG
tgttcccaagcccttactgc

SEQ ID NO: 310152 - DNA, 20 bp, Artificial Sequence
  Description of Artificial Sequence: Synthetic oligonucleotide
  Target: ATXN1; (+) strand; PAM type: YTN; PAM sequence: TTC
ccaagcccttactgccccaa

SEQ ID NO: 310153 - DNA, 20 bp, Artificial Sequence
  Description of Artificial Sequence: Synthetic oligonucleotide
  Target: ATXN1; (+) strand; PAM type: YTN; PAM sequence: CTT
actgccccaagttctagcaa

SEQ ID NO: 310154 - DNA, 20 bp, Artificial Sequence
  Description of Artificial Sequence: Synthetic oligonucleotide
  Target: ATXN1; (+) strand; PAM type: YTN; PAM sequence: TTA
ctgccccaagttctagcaaa

SEQ ID NO: 310155 - DNA, 20 bp, Artificial Sequence
  Description of Artificial Sequence: Synthetic oligonucleotide
  Target: ATXN1; (+) strand; PAM type: YTN; PAM sequence: CTG
ccccaagttctagcaaacct

SEQ ID NO: 310156 - DNA, 20 bp, Artificial Sequence
  Description of Artificial Sequence: Synthetic oligonucleotide
  Target: ATXN1; (+) strand; PAM type: YTN; PAM sequence: TTC
tagcaaacctctttttcctt

SEQ ID NO: 310157 - DNA, 20 bp, Artificial Sequence
  Description of Artificial Sequence: Synthetic oligonucleotide
  Target: ATXN1; (+) strand; PAM type: YTN; PAM sequence: CTA
gcaaacctctttttccttcc

SEQ ID NO: 310158 - DNA, 20 bp, Artificial Sequence
  Description of Artificial Sequence: Synthetic oligonucleotide
  Target: ATXN1; (+) strand; PAM type: YTN; PAM sequence: CTC
tttttccttcctgatttaat

SEQ ID NO: 310159 - DNA, 20 bp, Artificial Sequence
  Description of Artificial Sequence: Synthetic oligonucleotide
  Target: ATXN1; (+) strand; PAM type: YTN; PAM sequence: CTT
tttccttcctgatttaattt

SEQ ID NO: 310160 - DNA, 20 bp, Artificial Sequence
  Description of Artificial Sequence: Synthetic oligonucleotide
  Target: ATXN1; (+) strand; PAM type: YTN; PAM sequence: TTT
ttccttcctgatttaatttg

SEQ ID NO: 310161 - DNA, 20 bp, Artificial Sequence
  Description of Artificial Sequence: Synthetic oligonucleotide
  Target: ATXN1; (+) strand; PAM type: YTN; PAM sequence: TTT
tccttcctgatttaatttga

SEQ ID NO: 310162 - DNA, 20 bp, Artificial Sequence
  Description of Artificial Sequence: Synthetic oligonucleotide
  Target: ATXN1; (+) strand; PAM type: YTN; PAM sequence: TTT
ccttcctgatttaatttgag

SEQ ID NO: 310163 - DNA, 20 bp, Artificial Sequence
  Description of Artificial Sequence: Synthetic oligonucleotide
  Target: ATXN1; (+) strand; PAM type: YTN; PAM sequence: TTC
cttcctgatttaatttgagg

SEQ ID NO: 310164 - DNA, 20 bp, Artificial Sequence
  Description of Artificial Sequence: Synthetic oligonucleotide
  Target: ATXN1; (+) strand; PAM type: YTN; PAM sequence: CTT
cctgatttaatttgaggcaa

SEQ ID NO: 310165 - DNA, 20 bp, Artificial Sequence
  Description of Artificial Sequence: Synthetic oligonucleotide
  Target: ATXN1; (+) strand; PAM type: YTN; PAM sequence: TTC
ctgatttaatttgaggcaat

SEQ ID NO: 310166 - DNA, 20 bp, Artificial Sequence
  Description of Artificial Sequence: Synthetic oligonucleotide
  Target: ATXN1; (+) strand; PAM type: YTN; PAM sequence: CTG
atttaatttgaggcaatatc

SEQ ID NO: 310167 - DNA, 20 bp, Artificial Sequence
  Description of Artificial Sequence: Synthetic oligonucleotide
  Target: ATXN1; (+) strand; PAM type: YTN; PAM sequence: TTT
aatttgaggcaatatcctct

SEQ ID NO: 310168 - DNA, 20 bp, Artificial Sequence
  Description of Artificial Sequence: Synthetic oligonucleotide
  Target: ATXN1; (+) strand; PAM type: YTN; PAM sequence: TTA
atttgaggcaatatcctctg

SEQ ID NO: 310169 - DNA, 20 bp, Artificial Sequence
  Description of Artificial Sequence: Synthetic oligonucleotide
  Target: ATXN1; (+) strand; PAM type: YTN; PAM sequence: TTT
gaggcaatatcctctggccc

SEQ ID NO: 310170 - DNA, 20 bp, Artificial Sequence
  Description of Artificial Sequence: Synthetic oligonucleotide
  Target: ATXN1; (+) strand; PAM type: YTN; PAM sequence: TTG
aggcaatatcctctggccct

SEQ ID NO: 310171 - DNA, 20 bp, Artificial Sequence
  Description of Artificial Sequence: Synthetic oligonucleotide
  Target: ATXN1; (+) strand; PAM type: YTN; PAM sequence: CTC
tggccctttcttcaatagag

SEQ ID NO: 310172 - DNA, 20 bp, Artificial Sequence
  Description of Artificial Sequence: Synthetic oligonucleotide
  Target: ATXN1; (+) strand; PAM type: YTN; PAM sequence: CTG
gccctttcttcaatagagaa

SEQ ID NO: 310173 - DNA, 20 bp, Artificial Sequence
  Description of Artificial Sequence: Synthetic oligonucleotide
  Target: ATXN1; (+) strand; PAM type: YTN; PAM sequence: CTT
tcttcaatagagaaccatga

SEQ ID NO: 310174 - DNA, 20 bp, Artificial Sequence
  Description of Artificial Sequence: Synthetic oligonucleotide
  Target: ATXN1; (+) strand; PAM type: YTN; PAM sequence: TTT
cttcaatagagaaccatgag

SEQ ID NO: 310175 - DNA, 20 bp, Artificial Sequence
  Description of Artificial Sequence: Synthetic oligonucleotide
  Target: ATXN1; (+) strand; PAM type: YTN; PAM sequence: TTC
ttcaatagagaaccatgagt

SEQ ID NO: 310176 - DNA, 20 bp, Artificial Sequence
  Description of Artificial Sequence: Synthetic oligonucleotide
  Target: ATXN1; (+) strand; PAM type: YTN; PAM sequence: CTT
caatagagaaccatgagtca

SEQ ID NO: 310177 - DNA, 20 bp, Artificial Sequence
  Description of Artificial Sequence: Synthetic oligonucleotide
  Target: ATXN1; (+) strand; PAM type: YTN; PAM sequence: TTC
aatagagaaccatgagtcat

SEQ ID NO: 310178 - DNA, 20 bp, Artificial Sequence
  Description of Artificial Sequence: Synthetic oligonucleotide
  Target: ATXN1; (+) strand; PAM type: YTN; PAM sequence: TTG
catacaccctatgtctgcat

SEQ ID NO: 310179 - DNA, 20 bp, Artificial Sequence
  Description of Artificial Sequence: Synthetic oligonucleotide
  Target: ATXN1; (+) strand; PAM type: YTN; PAM sequence: CTA
tgtctgcatgactctccagg

SEQ ID NO: 310180 - DNA, 20 bp, Artificial Sequence
  Description of Artificial Sequence: Synthetic oligonucleotide
  Target: ATXN1; (+) strand; PAM type: YTN; PAM sequence: CTG
catgactctccaggccagaa

SEQ ID NO: 310181 - DNA, 20 bp, Artificial Sequence
  Description of Artificial Sequence: Synthetic oligonucleotide
  Target: ATXN1; (+) strand; PAM type: YTN; PAM sequence: CTC
tccaggccagaaaaacttac

SEQ ID NO: 310182 - DNA, 20 bp, Artificial Sequence
  Description of Artificial Sequence: Synthetic oligonucleotide
  Target: ATXN1; (+) strand; PAM type: YTN; PAM sequence: CTC
caggccagaaaaacttactg

SEQ ID NO: 310183 - DNA, 20 bp, Artificial Sequence
  Description of Artificial Sequence: Synthetic oligonucleotide
  Target: ATXN1; (+) strand; PAM type: YTN; PAM sequence: CTT
actgtacgtgggaaaatcag

SEQ ID NO: 310184 - DNA, 20 bp, Artificial Sequence
  Description of Artificial Sequence: Synthetic oligonucleotide
  Target: ATXN1; (+) strand; PAM type: YTN; PAM sequence: TTA
ctgtacgtgggaaaatcagg

SEQ ID NO: 310185 - DNA, 20 bp, Artificial Sequence
  Description of Artificial Sequence: Synthetic oligonucleotide
  Target: ATXN1; (+) strand; PAM type: YTN; PAM sequence: CTG
tacgtgggaaaatcaggaag

SEQ ID NO: 310186 - DNA, 20 bp, Artificial Sequence
  Description of Artificial Sequence: Synthetic oligonucleotide
  Target: ATXN1; (+) strand; PAM type: YTN; PAM sequence: TTG
taaaatccaaacagacacaa

SEQ ID NO: 310187 - DNA, 20 bp, Artificial Sequence
  Description of Artificial Sequence: Synthetic oligonucleotide
  Target: ATXN1; (+) strand; PAM type: YTN; PAM sequence: TTC
aagattcaacaaatactggt

SEQ ID NO: 310188 - DNA, 20 bp, Artificial Sequence
  Description of Artificial Sequence: Synthetic oligonucleotide
  Target: ATXN1; (+) strand; PAM type: YTN; PAM sequence: TTC
aacaaatactggttccccta

SEQ ID NO: 310189 - DNA, 20 bp, Artificial Sequence
  Description of Artificial Sequence: Synthetic oligonucleotide
  Target: ATXN1; (+) strand; PAM type: YTN; PAM sequence: CTG
gttcccctaaacaaataggt

SEQ ID NO: 310190 - DNA, 20 bp, Artificial Sequence
  Description of Artificial Sequence: Synthetic oligonucleotide
  Target: ATXN1; (+) strand; PAM type: YTN; PAM sequence: TTC
ccctaaacaaataggtctct

SEQ ID NO: 310191 - DNA, 20 bp, Artificial Sequence
  Description of Artificial Sequence: Synthetic oligonucleotide
  Target: ATXN1; (+) strand; PAM type: YTN; PAM sequence: CTA
aacaaataggtctctgtttt

SEQ ID NO: 310192 - DNA, 20 bp, Artificial Sequence
  Description of Artificial Sequence: Synthetic oligonucleotide
  Target: ATXN1; (+) strand; PAM type: YTN; PAM sequence: CTC
tgttttgctacgcacatatt

SEQ ID NO: 310193 - DNA, 20 bp, Artificial Sequence
  Description of Artificial Sequence: Synthetic oligonucleotide
  Target: ATXN1; (+) strand; PAM type: YTN; PAM sequence: CTG
ttttgctacgcacatattat

SEQ ID NO: 310194 - DNA, 20 bp, Artificial Sequence
  Description of Artificial Sequence: Synthetic oligonucleotide
  Target: ATXN1; (+) strand; PAM type: YTN; PAM sequence: TTT
tgctacgcacatattatact

SEQ ID NO: 310195 - DNA, 20 bp, Artificial Sequence
  Description of Artificial Sequence: Synthetic oligonucleotide
  Target: ATXN1; (+) strand; PAM type: YTN; PAM sequence: TTT
gctacgcacatattatacta

SEQ ID NO: 310196 - DNA, 20 bp, Artificial Sequence
  Description of Artificial Sequence: Synthetic oligonucleotide
  Target: ATXN1; (+) strand; PAM type: YTN; PAM sequence: TTG
ctacgcacatattatactac

SEQ ID NO: 310197 - DNA, 20 bp, Artificial Sequence
  Description of Artificial Sequence: Synthetic oligonucleotide
  Target: ATXN1; (+) strand; PAM type: YTN; PAM sequence: CTA
cgcacatattatactacaac

SEQ ID NO: 310198 - DNA, 20 bp, Artificial Sequence
  Description of Artificial Sequence: Synthetic oligonucleotide
  Target: ATXN1; (+) strand; PAM type: YTN; PAM sequence: TTA
tactacaacagtaatctaaa

SEQ ID NO: 310199 - DNA, 20 bp, Artificial Sequence
  Description of Artificial Sequence: Synthetic oligonucleotide
  Target: ATXN1; (+) strand; PAM type: YTN; PAM sequence: CTA
caacagtaatctaaaatgca

SEQ ID NO: 310200 - DNA, 20 bp, Artificial Sequence
  Description of Artificial Sequence: Synthetic oligonucleotide
  Target: ATXN1; (+) strand; PAM type: YTN; PAM sequence: CTA
aaatgcaaaaactgtgactt

SEQ ID NO: 310201 - DNA, 20 bp, Artificial Sequence
  Description of Artificial Sequence: Synthetic oligonucleotide
  Target: ATXN1; (+) strand; PAM type: YTN; PAM sequence: CTG
tgacttaagatatctggtag

SEQ ID NO: 310202 - DNA, 20 bp, Artificial Sequence
  Description of Artificial Sequence: Synthetic oligonucleotide
  Target: ATXN1; (+) strand; PAM type: YTN; PAM sequence: CTT
aagatatctggtagcatagc

SEQ ID NO: 310203 - DNA, 20 bp, Artificial Sequence
  Description of Artificial Sequence: Synthetic oligonucleotide
  Target: ATXN1; (+) strand; PAM type: YTN; PAM sequence: TTA
agatatctggtagcatagca

SEQ ID NO: 310204 - DNA, 20 bp, Artificial Sequence
  Description of Artificial Sequence: Synthetic oligonucleotide
  Target: ATXN1; (+) strand; PAM type: YTN; PAM sequence: CTG
gtagcatagcattcttaatt

SEQ ID NO: 310205 - DNA, 20 bp, Artificial Sequence
  Description of Artificial Sequence: Synthetic oligonucleotide
  Target: ATXN1; (+) strand; PAM type: YTN; PAM sequence: TTC
ttaattgtattaaggaaaac

SEQ ID NO: 310206 - DNA, 20 bp, Artificial Sequence
  Description of Artificial Sequence: Synthetic oligonucleotide
  Target: ATXN1; (+) strand; PAM type: YTN; PAM sequence: CTT
aattgtattaaggaaaactg

SEQ ID NO: 310207 - DNA, 20 bp, Artificial Sequence
  Description of Artificial Sequence: Synthetic oligonucleotide
  Target: ATXN1; (+) strand; PAM type: YTN; PAM sequence: TTA
attgtattaaggaaaactga

SEQ ID NO: 310208 - DNA, 20 bp, Artificial Sequence
  Description of Artificial Sequence: Synthetic oligonucleotide
  Target: ATXN1; (+) strand; PAM type: YTN; PAM sequence: TTG
tattaaggaaaactgacaat

SEQ ID NO: 310209 - DNA, 20 bp, Artificial Sequence
  Description of Artificial Sequence: Synthetic oligonucleotide
  Target: ATXN1; (+) strand; PAM type: YTN; PAM sequence: TTA
aggaaaactgacaattaaaa

SEQ ID NO: 310210 - DNA, 20 bp, Artificial Sequence
  Description of Artificial Sequence: Synthetic oligonucleotide
  Target: ATXN1; (+) strand; PAM type: YTN; PAM sequence: CTG
acaattaaaatgatgaggtt

SEQ ID NO: 310211 - DNA, 20 bp, Artificial Sequence
  Description of Artificial Sequence: Synthetic oligonucleotide
  Target: ATXN1; (+) strand; PAM type: YTN; PAM sequence: TTA
aaatgatgaggttcaagccc

SEQ ID NO: 310212 - DNA, 20 bp, Artificial Sequence
  Description of Artificial Sequence: Synthetic oligonucleotide
  Target: ATXN1; (+) strand; PAM type: YTN; PAM sequence: TTC
aagccccaattggcaattat

SEQ ID NO: 310213 - DNA, 20 bp, Artificial Sequence
  Description of Artificial Sequence: Synthetic oligonucleotide
  Target: ATXN1; (+) strand; PAM type: YTN; PAM sequence: TTG
gcaattatcaatcatcgcaa

SEQ ID NO: 310214 - DNA, 20 bp, Artificial Sequence
  Description of Artificial Sequence: Synthetic oligonucleotide
  Target: ATXN1; (+) strand; PAM type: YTN; PAM sequence: TTA
tcaatcatcgcaaagtcaaa

SEQ ID NO: 310215 - DNA, 20 bp, Artificial Sequence
  Description of Artificial Sequence: Synthetic oligonucleotide
  Target: ATXN1; (+) strand; PAM type: YTN; PAM sequence: CTT
catgaacatatagattaaac

SEQ ID NO: 310216 - DNA, 20 bp, Artificial Sequence
  Description of Artificial Sequence: Synthetic oligonucleotide
  Target: ATXN1; (+) strand; PAM type: YTN; PAM sequence: TTC
atgaacatatagattaaacc

SEQ ID NO: 310217 - DNA, 20 bp, Artificial Sequence
  Description of Artificial Sequence: Synthetic oligonucleotide
  Target: ATXN1; (+) strand; PAM type: YTN; PAM sequence: TTA
aaccaaatagatagatactt

SEQ ID NO: 310218 - DNA, 20 bp, Artificial Sequence
  Description of Artificial Sequence: Synthetic oligonucleotide
  Target: ATXN1; (+) strand; PAM type: YTN; PAM sequence: CTT
taatcgaagttttaaaaaac

SEQ ID NO: 310219 - DNA, 20 bp, Artificial Sequence
  Description of Artificial Sequence: Synthetic oligonucleotide
  Target: ATXN1; (+) strand; PAM type: YTN; PAM sequence: TTT
aatcgaagttttaaaaaaca

SEQ ID NO: 310220 - DNA, 20 bp, Artificial Sequence
  Description of Artificial Sequence: Synthetic oligonucleotide
  Target: ATXN1; (+) strand; PAM type: YTN; PAM sequence: TTA
atcgaagttttaaaaaacaa

SEQ ID NO: 310221 - DNA, 20 bp, Artificial Sequence
  Description of Artificial Sequence: Synthetic oligonucleotide
  Target: ATXN1; (+) strand; PAM type: YTN; PAM sequence: TTT
taaaaaacaatcttggcaat

SEQ ID NO: 310222 - DNA, 20 bp, Artificial Sequence
  Description of Artificial Sequence: Synthetic oligonucleotide
  Target: ATXN1; (+) strand; PAM type: YTN; PAM sequence: TTT
aaaaaacaatcttggcaatt

SEQ ID NO: 310223 - DNA, 20 bp, Artificial Sequence
  Description of Artificial Sequence: Synthetic oligonucleotide
  Target: ATXN1; (+) strand; PAM type: YTN; PAM sequence: TTA
aaaaacaatcttggcaattt

SEQ ID NO: 310224 - DNA, 20 bp, Artificial Sequence
  Description of Artificial Sequence: Synthetic oligonucleotide
  Target: ATXN1; (+) strand; PAM type: YTN; PAM sequence: CTT
ggcaatttctcaacttccca

SEQ ID NO: 310225 - DNA, 20 bp, Artificial Sequence
  Description of Artificial Sequence: Synthetic oligonucleotide
  Target: ATXN1; (+) strand; PAM type: YTN; PAM sequence: TTG
gcaatttctcaacttcccac

SEQ ID NO: 310226 - DNA, 20 bp, Artificial Sequence
  Description of Artificial Sequence: Synthetic oligonucleotide
  Target: ATXN1; (+) strand; PAM type: YTN; PAM sequence: TTT
ctcaacttcccacactatgc

SEQ ID NO: 310227 - DNA, 20 bp, Artificial Sequence
  Description of Artificial Sequence: Synthetic oligonucleotide
  Target: ATXN1; (+) strand; PAM type: YTN; PAM sequence: TTC
tcaacttcccacactatgcc

SEQ ID NO: 310228 - DNA, 20 bp, Artificial Sequence
  Description of Artificial Sequence: Synthetic oligonucleotide
  Target: ATXN1; (+) strand; PAM type: YTN; PAM sequence: CTC
aacttcccacactatgccca

SEQ ID NO: 310229 - DNA, 20 bp, Artificial Sequence
  Description of Artificial Sequence: Synthetic oligonucleotide
  Target: ATXN1; (+) strand; PAM type: YTN; PAM sequence: CTT
cccacactatgcccaaacag

SEQ ID NO: 310230 - DNA, 20 bp, Artificial Sequence
  Description of Artificial Sequence: Synthetic oligonucleotide
  Target: ATXN1; (+) strand; PAM type: YTN; PAM sequence: TTC
ccacactatgcccaaacaga

SEQ ID NO: 310231 - DNA, 20 bp, Artificial Sequence
  Description of Artificial Sequence: Synthetic oligonucleotide
  Target: ATXN1; (+) strand; PAM type: YTN; PAM sequence: CTA
tgcccaaacagagtttgcaa

SEQ ID NO: 310232 - DNA, 20 bp, Artificial Sequence
  Description of Artificial Sequence: Synthetic oligonucleotide
  Target: ATXN1; (+) strand; PAM type: YTN; PAM sequence: TTT
gcaaagaaaatgatattcaa

SEQ ID NO: 310233 - DNA, 20 bp, Artificial Sequence
  Description of Artificial Sequence: Synthetic oligonucleotide
  Target: ATXN1; (+) strand; PAM type: YTN; PAM sequence: TTG
caaagaaaatgatattcaac

SEQ ID NO: 310234 - DNA, 20 bp, Artificial Sequence
  Description of Artificial Sequence: Synthetic oligonucleotide
  Target: ATXN1; (+) strand; PAM type: YTN; PAM sequence: TTC
aacagccaacaaagtaaggg

SEQ ID NO: 310235 - DNA, 20 bp, Artificial Sequence
  Description of Artificial Sequence: Synthetic oligonucleotide
  Target: ATXN1; (+) strand; PAM type: YTN; PAM sequence: CTA
ggaggcaattttccaggtca

SEQ ID NO: 310236 - DNA, 20 bp, Artificial Sequence
  Description of Artificial Sequence: Synthetic oligonucleotide
  Target: ATXN1; (+) strand; PAM type: YTN; PAM sequence: TTT
tccaggtcaggactttatcc

SEQ ID NO: 310237 - DNA, 20 bp, Artificial Sequence
  Description of Artificial Sequence: Synthetic oligonucleotide
  Target: ATXN1; (+) strand; PAM type: YTN; PAM sequence: TTT
ccaggtcaggactttatcct

SEQ ID NO: 310238 - DNA, 20 bp, Artificial Sequence
  Description of Artificial Sequence: Synthetic oligonucleotide
  Target: ATXN1; (+) strand; PAM type: YTN; PAM sequence: TTC
caggtcaggactttatcctc

SEQ ID NO: 310239 - DNA, 20 bp, Artificial Sequence
  Description of Artificial Sequence: Synthetic oligonucleotide
  Target: ATXN1; (+) strand; PAM type: YTN; PAM sequence: CTT
tatcctcagatggaaaacag

SEQ ID NO: 310240 - DNA, 20 bp, Artificial Sequence
  Description of Artificial Sequence: Synthetic oligonucleotide
  Target: ATXN1; (+) strand; PAM type: YTN; PAM sequence: TTT
atcctcagatggaaaacaga

SEQ ID NO: 310241 - DNA, 20 bp, Artificial Sequence
  Description of Artificial Sequence: Synthetic oligonucleotide
  Target: ATXN1; (+) strand; PAM type: YTN; PAM sequence: TTA
tcctcagatggaaaacagag

SEQ ID NO: 310242 - DNA, 20 bp, Artificial Sequence
  Description of Artificial Sequence: Synthetic oligonucleotide
  Target: ATXN1; (+) strand; PAM type: YTN; PAM sequence: CTC
agatggaaaacagagagcat

SEQ ID NO: 310243 - DNA, 20 bp, Artificial Sequence
  Description of Artificial Sequence: Synthetic oligonucleotide
  Target: ATXN1; (+) strand; PAM type: YTN; PAM sequence: CTC
tcacctgacatgtgatgcac

SEQ ID NO: 310244 - DNA, 20 bp, Artificial Sequence
  Description of Artificial Sequence: Synthetic oligonucleotide
  Target: ATXN1; (+) strand; PAM type: YTN; PAM sequence: CTC
acctgacatgtgatgcactt

SEQ ID NO: 310245 - DNA, 20 bp, Artificial Sequence
  Description of Artificial Sequence: Synthetic oligonucleotide
  Target: ATXN1; (+) strand; PAM type: YTN; PAM sequence: CTG
acatgtgatgcacttccctg

SEQ ID NO: 310246 - DNA, 20 bp, Artificial Sequence
  Description of Artificial Sequence: Synthetic oligonucleotide
  Target: ATXN1; (+) strand; PAM type: YTN; PAM sequence: CTT
ccctgtagtggcagtggagg

SEQ ID NO: 310247 - DNA, 20 bp, Artificial Sequence
  Description of Artificial Sequence: Synthetic oligonucleotide
  Target: ATXN1; (+) strand; PAM type: YTN; PAM sequence: TTC
cctgtagtggcagtggagga

SEQ ID NO: 310248 - DNA, 20 bp, Artificial Sequence
  Description of Artificial Sequence: Synthetic oligonucleotide
  Target: ATXN1; (+) strand; PAM type: YTN; PAM sequence: CTG
tagtggcagtggaggaggag

SEQ ID NO: 310249 - DNA, 20 bp, Artificial Sequence
  Description of Artificial Sequence: Synthetic oligonucleotide
  Target: ATXN1; (+) strand; PAM type: YTN; PAM sequence: TTG
ctgtacaaggatgacaaaca

SEQ ID NO: 310250 - DNA, 20 bp, Artificial Sequence
  Description of Artificial Sequence: Synthetic oligonucleotide
  Target: ATXN1; (+) strand; PAM type: YTN; PAM sequence: CTG
tacaaggatgacaaacaaat

SEQ ID NO: 310251 - DNA, 20 bp, Artificial Sequence
  Description of Artificial Sequence: Synthetic oligonucleotide
  Target: ATXN1; (+) strand; PAM type: YTN; PAM sequence: CTG
cagcttgaatggaccaccct

SEQ ID NO: 310252 - DNA, 20 bp, Artificial Sequence
  Description of Artificial Sequence: Synthetic oligonucleotide
  Target: ATXN1; (+) strand; PAM type: YTN; PAM sequence: CTT
gaatggaccaccctggtgac

SEQ ID NO: 310253 - DNA, 20 bp, Artificial Sequence
  Description of Artificial Sequence: Synthetic oligonucleotide
  Target: ATXN1; (+) strand; PAM type: YTN; PAM sequence: TTG
aatggaccaccctggtgact

SEQ ID NO: 310254 - DNA, 20 bp, Artificial Sequence
  Description of Artificial Sequence: Synthetic oligonucleotide
  Target: ATXN1; (+) strand; PAM type: YTN; PAM sequence: CTG
gtgacttgatgcacgatgct

SEQ ID NO: 310255 - DNA, 20 bp, Artificial Sequence
  Description of Artificial Sequence: Synthetic oligonucleotide
  Target: ATXN1; (+) strand; PAM type: YTN; PAM sequence: CTT
gatgcacgatgctcctgcaa

SEQ ID NO: 310256 - DNA, 20 bp, Artificial Sequence
  Description of Artificial Sequence: Synthetic oligonucleotide
  Target: ATXN1; (+) strand; PAM type: YTN; PAM sequence: TTG
atgcacgatgctcctgcaat

SEQ ID NO: 310257 - DNA, 20 bp, Artificial Sequence
  Description of Artificial Sequence: Synthetic oligonucleotide
  Target: ATXN1; (+) strand; PAM type: YTN; PAM sequence: CTC
ctgcaatggtcgagggagtg

SEQ ID NO: 310258 - DNA, 20 bp, Artificial Sequence
  Description of Artificial Sequence: Synthetic oligonucleotide
  Target: ATXN1; (+) strand; PAM type: YTN; PAM sequence: CTG
caatggtcgagggagtgcag

SEQ ID NO: 310259 - DNA, 20 bp, Artificial Sequence
  Description of Artificial Sequence: Synthetic oligonucleotide
  Target: ATXN1; (+) strand; PAM type: YTN; PAM sequence: CTG
ctttaaaaaataagtccacc

SEQ ID NO: 310260 - DNA, 20 bp, Artificial Sequence
  Description of Artificial Sequence: Synthetic oligonucleotide
  Target: ATXN1; (+) strand; PAM type: YTN; PAM sequence: CTT
taaaaaataagtccacctta

SEQ ID NO: 310261 - DNA, 20 bp, Artificial Sequence
  Description of Artificial Sequence: Synthetic oligonucleotide
  Target: ATXN1; (+) strand; PAM type: YTN; PAM sequence: TTT
aaaaaataagtccaccttaa

SEQ ID NO: 310262 - DNA, 20 bp, Artificial Sequence
  Description of Artificial Sequence: Synthetic oligonucleotide
  Target: ATXN1; (+) strand; PAM type: YTN; PAM sequence: TTA
aaaaataagtccaccttaag

SEQ ID NO: 310263 - DNA, 20 bp, Artificial Sequence
  Description of Artificial Sequence: Synthetic oligonucleotide
  Target: ATXN1; (+) strand; PAM type: YTN; PAM sequence: CTT
aagtgtctatgcaccgaaat

SEQ ID NO: 310264 - DNA, 20 bp, Artificial Sequence
  Description of Artificial Sequence: Synthetic oligonucleotide
  Target: ATXN1; (+) strand; PAM type: YTN; PAM sequence: TTA
agtgtctatgcaccgaaata

SEQ ID NO: 310265 - DNA, 20 bp, Artificial Sequence
  Description of Artificial Sequence: Synthetic oligonucleotide
  Target: ATXN1; (+) strand; PAM type: YTN; PAM sequence: CTA
tgcaccgaaatacaaatttt

SEQ ID NO: 310266 - DNA, 20 bp, Artificial Sequence
  Description of Artificial Sequence: Synthetic oligonucleotide
  Target: ATXN1; (+) strand; PAM type: YTN; PAM sequence: TTT
taagaacatcacattcggca

SEQ ID NO: 310267 - DNA, 20 bp, Artificial Sequence
  Description of Artificial Sequence: Synthetic oligonucleotide
  Target: ATXN1; (+) strand; PAM type: YTN; PAM sequence: TTT
aagaacatcacattcggcat

SEQ ID NO: 310268 - DNA, 20 bp, Artificial Sequence
  Description of Artificial Sequence: Synthetic oligonucleotide
  Target: ATXN1; (+) strand; PAM type: YTN; PAM sequence: TTA
agaacatcacattcggcatt

SEQ ID NO: 310269 - DNA, 20 bp, Artificial Sequence
  Description of Artificial Sequence: Synthetic oligonucleotide
  Target: ATXN1; (+) strand; PAM type: YTN; PAM sequence: TTC
ggcattctgttgtatgagaa

SEQ ID NO: 310270 - DNA, 20 bp, Artificial Sequence
  Description of Artificial Sequence: Synthetic oligonucleotide
  Target: ATXN1; (+) strand; PAM type: YTN; PAM sequence: TTC
tgttgtatgagaattacaca

SEQ ID NO: 310271 - DNA, 20 bp, Artificial Sequence
  Description of Artificial Sequence: Synthetic oligonucleotide
  Target: ATXN1; (+) strand; PAM type: YTN; PAM sequence: CTG
ttgtatgagaattacacaga

SEQ ID NO: 310272 - DNA, 20 bp, Artificial Sequence
  Description of Artificial Sequence: Synthetic oligonucleotide
  Target: ATXN1; (+) strand; PAM type: YTN; PAM sequence: TTG
tatgagaattacacagatcc

SEQ ID NO: 310273 - DNA, 20 bp, Artificial Sequence
  Description of Artificial Sequence: Synthetic oligonucleotide
  Target: ATXN1; (+) strand; PAM type: YTN; PAM sequence: TTA
cacagatcccagccagctca

SEQ ID NO: 310274 - DNA, 20 bp, Artificial Sequence
  Description of Artificial Sequence: Synthetic oligonucleotide
  Target: ATXN1; (+) strand; PAM type: YTN; PAM sequence: CTC
aaaaggcaggtctggtttta

SEQ ID NO: 310275 - DNA, 20 bp, Artificial Sequence
  Description of Artificial Sequence: Synthetic oligonucleotide
  Target: ATXN1; (+) strand; PAM type: YTN; PAM sequence: CTG
gttttactcaacaaggctca

SEQ ID NO: 310276 - DNA, 20 bp, Artificial Sequence
  Description of Artificial Sequence: Synthetic oligonucleotide
  Target: ATXN1; (+) strand; PAM type: YTN; PAM sequence: TTT
tactcaacaaggctcagagg

SEQ ID NO: 310277 - DNA, 20 bp, Artificial Sequence
  Description of Artificial Sequence: Synthetic oligonucleotide
  Target: ATXN1; (+) strand; PAM type: YTN; PAM sequence: TTT
actcaacaaggctcagaggg

SEQ ID NO: 310278 - DNA, 20 bp, Artificial Sequence
  Description of Artificial Sequence: Synthetic oligonucleotide
  Target: ATXN1; (+) strand; PAM type: YTN; PAM sequence: TTA
ctcaacaaggctcagaggga

SEQ ID NO: 310279 - DNA, 20 bp, Artificial Sequence
  Description of Artificial Sequence: Synthetic oligonucleotide
  Target: ATXN1; (+) strand; PAM type: YTN; PAM sequence: CTC
aacaaggctcagagggaggc

SEQ ID NO: 310280 - DNA, 20 bp, Artificial Sequence
  Description of Artificial Sequence: Synthetic oligonucleotide
  Target: ATXN1; (+) strand; PAM type: YTN; PAM sequence: CTC
agagggaggccaacatacaa

SEQ ID NO: 310281 - DNA, 20 bp, Artificial Sequence
  Description of Artificial Sequence: Synthetic oligonucleotide
  Target: ATXN1; (+) strand; PAM type: YTN; PAM sequence: CTT
ccatcaaattaagaggatgg

SEQ ID NO: 310282 - DNA, 20 bp, Artificial Sequence
  Description of Artificial Sequence: Synthetic oligonucleotide
  Target: ATXN1; (+) strand; PAM type: YTN; PAM sequence: TTC
catcaaattaagaggatggt

SEQ ID NO: 310283 - DNA, 20 bp, Artificial Sequence
  Description of Artificial Sequence: Synthetic oligonucleotide
  Target: ATXN1; (+) strand; PAM type: YTN; PAM sequence: TTA
agaggatggtctccccattt

SEQ ID NO: 310284 - DNA, 20 bp, Artificial Sequence
  Description of Artificial Sequence: Synthetic oligonucleotide
  Target: ATXN1; (+) strand; PAM type: YTN; PAM sequence: CTC
cccatttgagccagccgctg

SEQ ID NO: 310285 - DNA, 20 bp, Artificial Sequence
  Description of Artificial Sequence: Synthetic oligonucleotide
  Target: ATXN1; (+) strand; PAM type: YTN; PAM sequence: TTT
gagccagccgctgtcattct

SEQ ID NO: 310286 - DNA, 20 bp, Artificial Sequence
  Description of Artificial Sequence: Synthetic oligonucleotide
  Target: ATXN1; (+) strand; PAM type: YTN; PAM sequence: TTG
agccagccgctgtcattctt

SEQ ID NO: 310287 - DNA, 20 bp, Artificial Sequence
  Description of Artificial Sequence: Synthetic oligonucleotide
  Target: ATXN1; (+) strand; PAM type: YTN; PAM sequence: CTG
tcattcttttctccaatgat

SEQ ID NO: 310288 - DNA, 20 bp, Artificial Sequence
  Description of Artificial Sequence: Synthetic oligonucleotide
  Target: ATXN1; (+) strand; PAM type: YTN; PAM sequence: TTC
ttttctccaatgattctagc

SEQ ID NO: 310289 - DNA, 20 bp, Artificial Sequence
  Description of Artificial Sequence: Synthetic oligonucleotide
  Target: ATXN1; (+) strand; PAM type: YTN; PAM sequence: CTT
ttctccaatgattctagcca

SEQ ID NO: 310290 - DNA, 20 bp, Artificial Sequence
  Description of Artificial Sequence: Synthetic oligonucleotide
  Target: ATXN1; (+) strand; PAM type: YTN; PAM sequence: TTT
tctccaatgattctagccaa

SEQ ID NO: 310291 - DNA, 20 bp, Artificial Sequence
  Description of Artificial Sequence: Synthetic oligonucleotide
  Target: ATXN1; (+) strand; PAM type: YTN; PAM sequence: TTT
ctccaatgattctagccaat

SEQ ID NO: 310292 - DNA, 20 bp, Artificial Sequence
  Description of Artificial Sequence: Synthetic oligonucleotide
  Target: ATXN1; (+) strand; PAM type: YTN; PAM sequence: TTC
tccaatgattctagccaatc

SEQ ID NO: 310293 - DNA, 20 bp, Artificial Sequence
  Description of Artificial Sequence: Synthetic oligonucleotide
  Target: ATXN1; (+) strand; PAM type: YTN; PAM sequence: CTC
caatgattctagccaatcat

SEQ ID NO: 310294 - DNA, 20 bp, Artificial Sequence
  Description of Artificial Sequence: Synthetic oligonucleotide
  Target: ATXN1; (+) strand; PAM type: YTN; PAM sequence: TTC
tagccaatcatctgataaac

SEQ ID NO: 310295 - DNA, 20 bp, Artificial Sequence
  Description of Artificial Sequence: Synthetic oligonucleotide
  Target: ATXN1; (+) strand; PAM type: YTN; PAM sequence: CTA
gccaatcatctgataaacac

SEQ ID NO: 310296 - DNA, 20 bp, Artificial Sequence
  Description of Artificial Sequence: Synthetic oligonucleotide
  Target: ATXN1; (+) strand; PAM type: YTN; PAM sequence: CTG
ataaacacatgctggtaact

SEQ ID NO: 310297 - DNA, 20 bp, Artificial Sequence
  Description of Artificial Sequence: Synthetic oligonucleotide
  Target: ATXN1; (+) strand; PAM type: YTN; PAM sequence: CTG
gtaactacaaggagtatcag

SEQ ID NO: 310298 - DNA, 20 bp, Artificial Sequence
  Description of Artificial Sequence: Synthetic oligonucleotide
  Target: ATXN1; (+) strand; PAM type: YTN; PAM sequence: CTA
caaggagtatcaggtgaaaa

SEQ ID NO: 310299 - DNA, 20 bp, Artificial Sequence
  Description of Artificial Sequence: Synthetic oligonucleotide
  Target: ATXN1; (+) strand; PAM type: YTN; PAM sequence: TTG
aatagtaattgagccaaagc

SEQ ID NO: 310300 - DNA, 20 bp, Artificial Sequence
  Description of Artificial Sequence: Synthetic oligonucleotide
  Target: ATXN1; (+) strand; PAM type: YTN; PAM sequence: TTG
agccaaagcctaattttaat

SEQ ID NO: 310301 - DNA, 20 bp, Artificial Sequence
  Description of Artificial Sequence: Synthetic oligonucleotide
  Target: ATXN1; (+) strand; PAM type: YTN; PAM sequence: CTA
attttaatgtggcatatatt

SEQ ID NO: 310302 - DNA, 20 bp, Artificial Sequence
  Description of Artificial Sequence: Synthetic oligonucleotide
  Target: ATXN1; (+) strand; PAM type: YTN; PAM sequence: TTT
taatgtggcatatattatct

SEQ ID NO: 310303 - DNA, 20 bp, Artificial Sequence
  Description of Artificial Sequence: Synthetic oligonucleotide
  Target: ATXN1; (+) strand; PAM type: YTN; PAM sequence: TTT
aatgtggcatatattatcta

SEQ ID NO: 310304 - DNA, 20 bp, Artificial Sequence
  Description of Artificial Sequence: Synthetic oligonucleotide
  Target: ATXN1; (+) strand; PAM type: YTN; PAM sequence: TTA
atgtggcatatattatctat

SEQ ID NO: 310305 - DNA, 20 bp, Artificial Sequence
  Description of Artificial Sequence: Synthetic oligonucleotide
  Target: ATXN1; (+) strand; PAM type: YTN; PAM sequence: TTA
tctatcaacatgcaacttga

SEQ ID NO: 310306 - DNA, 20 bp, Artificial Sequence
  Description of Artificial Sequence: Synthetic oligonucleotide
  Target: ATXN1; (+) strand; PAM type: YTN; PAM sequence: CTA
tcaacatgcaacttgaaaca

SEQ ID NO: 310307 - DNA, 20 bp, Artificial Sequence
  Description of Artificial Sequence: Synthetic oligonucleotide
  Target: ATXN1; (+) strand; PAM type: YTN; PAM sequence: CTT
gaaacacaatgatgaaagtg

SEQ ID NO: 310308 - DNA, 20 bp, Artificial Sequence
  Description of Artificial Sequence: Synthetic oligonucleotide
  Target: ATXN1; (+) strand; PAM type: YTN; PAM sequence: TTG
aaacacaatgatgaaagtgc

SEQ ID NO: 310309 - DNA, 20 bp, Artificial Sequence
  Description of Artificial Sequence: Synthetic oligonucleotide
  Target: ATXN1; (+) strand; PAM type: YTN; PAM sequence: CTA
ttagcataccagtccaatgg

SEQ ID NO: 310310 - DNA, 20 bp, Artificial Sequence
  Description of Artificial Sequence: Synthetic oligonucleotide
  Target: ATXN1; (+) strand; PAM type: YTN; PAM sequence: TTA
gcataccagtccaatggaat

SEQ ID NO: 310311 - DNA, 20 bp, Artificial Sequence
  Description of Artificial Sequence: Synthetic oligonucleotide
  Target: ATXN1; (+) strand; PAM type: YTN; PAM sequence: TTT
atattcactaaactttccac

SEQ ID NO: 310312 - DNA, 20 bp, Artificial Sequence
  Description of Artificial Sequence: Synthetic oligonucleotide
  Target: ATXN1; (+) strand; PAM type: YTN; PAM sequence: TTA
tattcactaaactttccact

SEQ ID NO: 310313 - DNA, 20 bp, Artificial Sequence
  Description of Artificial Sequence: Synthetic oligonucleotide
  Target: ATXN1; (+) strand; PAM type: YTN; PAM sequence: TTC
actaaactttccactaaact

SEQ ID NO: 310314 - DNA, 20 bp, Artificial Sequence
  Description of Artificial Sequence: Synthetic oligonucleotide
  Target: ATXN1; (+) strand; PAM type: YTN; PAM sequence: CTA
aactttccactaaactttat

SEQ ID NO: 310315 - DNA, 20 bp, Artificial Sequence
  Description of Artificial Sequence: Synthetic oligonucleotide
  Target: ATXN1; (+) strand; PAM type: YTN; PAM sequence: CTT
tccactaaactttatttaaa

SEQ ID NO: 310316 - DNA, 20 bp, Artificial Sequence
  Description of Artificial Sequence: Synthetic oligonucleotide
  Target: ATXN1; (+) strand; PAM type: YTN; PAM sequence: TTT
ccactaaactttatttaaat

SEQ ID NO: 310317 - DNA, 20 bp, Artificial Sequence
  Description of Artificial Sequence: Synthetic oligonucleotide
  Target: ATXN1; (+) strand; PAM type: YTN; PAM sequence: TTC
cactaaactttatttaaata

SEQ ID NO: 310318 - DNA, 20 bp, Artificial Sequence
  Description of Artificial Sequence: Synthetic oligonucleotide
  Target: ATXN1; (+) strand; PAM type: YTN; PAM sequence: CTA
aactttatttaaatactgaa

SEQ ID NO: 310319 - DNA, 20 bp, Artificial Sequence
  Description of Artificial Sequence: Synthetic oligonucleotide
  Target: ATXN1; (+) strand; PAM type: YTN; PAM sequence: CTT
tatttaaatactgaatgtac

SEQ ID NO: 310320 - DNA, 20 bp, Artificial Sequence
  Description of Artificial Sequence: Synthetic oligonucleotide
  Target: ATXN1; (+) strand; PAM type: YTN; PAM sequence: TTT
atttaaatactgaatgtaca

SEQ ID NO: 310321 - DNA, 20 bp, Artificial Sequence
  Description of Artificial Sequence: Synthetic oligonucleotide
  Target: ATXN1; (+) strand; PAM type: YTN; PAM sequence: TTA
tttaaatactgaatgtacat

SEQ ID NO: 310322 - DNA, 20 bp, Artificial Sequence
  Description of Artificial Sequence: Synthetic oligonucleotide
  Target: ATXN1; (+) strand; PAM type: YTN; PAM sequence: TTT
aaatactgaatgtacatctc

SEQ ID NO: 310323 - DNA, 20 bp, Artificial Sequence
  Description of Artificial Sequence: Synthetic oligonucleotide
  Target: ATXN1; (+) strand; PAM type: YTN; PAM sequence: TTA
aatactgaatgtacatctca

SEQ ID NO: 310324 - DNA, 20 bp, Artificial Sequence
  Description of Artificial Sequence: Synthetic oligonucleotide
  Target: ATXN1; (+) strand; PAM type: YTN; PAM sequence: CTG
aatgtacatctcattttcat

SEQ ID NO: 310325 - DNA, 20 bp, Artificial Sequence
  Description of Artificial Sequence: Synthetic oligonucleotide
  Target: ATXN1; (+) strand; PAM type: YTN; PAM sequence: CTC
attttcattttgccacaatt

SEQ ID NO: 310326 - DNA, 20 bp, Artificial Sequence
  Description of Artificial Sequence: Synthetic oligonucleotide
  Target: ATXN1; (+) strand; PAM type: YTN; PAM sequence: TTT
tcattttgccacaattcctt

SEQ ID NO: 310327 - DNA, 20 bp, Artificial Sequence
  Description of Artificial Sequence: Synthetic oligonucleotide
  Target: ATXN1; (+) strand; PAM type: YTN; PAM sequence: TTT
cattttgccacaattccttg

SEQ ID NO: 310328 - DNA, 20 bp, Artificial Sequence
  Description of Artificial Sequence: Synthetic oligonucleotide
  Target: ATXN1; (+) strand; PAM type: YTN; PAM sequence: TTC
attttgccacaattccttgc

SEQ ID NO: 310329 - DNA, 20 bp, Artificial Sequence
  Description of Artificial Sequence: Synthetic oligonucleotide
  Target: ATXN1; (+) strand; PAM type: YTN; PAM sequence: TTT
tgccacaattccttgcacat

SEQ ID NO: 310330 - DNA, 20 bp, Artificial Sequence
  Description of Artificial Sequence: Synthetic oligonucleotide
  Target: ATXN1; (+) strand; PAM type: YTN; PAM sequence: TTT
gccacaattccttgcacatg

SEQ ID NO: 310331 - DNA, 20 bp, Artificial Sequence
  Description of Artificial Sequence: Synthetic oligonucleotide
  Target: ATXN1; (+) strand; PAM type: YTN; PAM sequence: TTG
ccacaattccttgcacatgg

SEQ ID NO: 310332 - DNA, 20 bp, Artificial Sequence
  Description of Artificial Sequence: Synthetic oligonucleotide
  Target: ATXN1; (+) strand; PAM type: YTN; PAM sequence: TTC
cttgcacatggttaagtaaa

SEQ ID NO: 310333 - DNA, 20 bp, Artificial Sequence
  Description of Artificial Sequence: Synthetic oligonucleotide
  Target: ATXN1; (+) strand; PAM type: YTN; PAM sequence: CTT
gcacatggttaagtaaaaat

SEQ ID NO: 310334 - DNA, 20 bp, Artificial Sequence
  Description of Artificial Sequence: Synthetic oligonucleotide
  Target: ATXN1; (+) strand; PAM type: YTN; PAM sequence: TTG
cacatggttaagtaaaaatt

SEQ ID NO: 310335 - DNA, 20 bp, Artificial Sequence
  Description of Artificial Sequence: Synthetic oligonucleotide
  Target: ATXN1; (+) strand; PAM type: YTN; PAM sequence: TTA
agtaaaaattttccattgta

SEQ ID NO: 310336 - DNA, 20 bp, Artificial Sequence
  Description of Artificial Sequence: Synthetic oligonucleotide
  Target: ATXN1; (+) strand; PAM type: YTN; PAM sequence: TTT
tccattgtatgatgaatgag

SEQ ID NO: 310337 - DNA, 20 bp, Artificial Sequence
  Description of Artificial Sequence: Synthetic oligonucleotide
  Target: ATXN1; (+) strand; PAM type: YTN; PAM sequence: TTT
ccattgtatgatgaatgagt

SEQ ID NO: 310338 - DNA, 20 bp, Artificial Sequence
  Description of Artificial Sequence: Synthetic oligonucleotide
  Target: ATXN1; (+) strand; PAM type: YTN; PAM sequence: TTC
cattgtatgatgaatgagtg

SEQ ID NO: 310339 - DNA, 20 bp, Artificial Sequence
  Description of Artificial Sequence: Synthetic oligonucleotide
  Target: ATXN1; (+) strand; PAM type: YTN; PAM sequence: TTG
tatgatgaatgagtgaatgt

SEQ ID NO: 310340 - DNA, 20 bp, Artificial Sequence
  Description of Artificial Sequence: Synthetic oligonucleotide
  Target: ATXN1; (+) strand; PAM type: YTN; PAM sequence: CTT
ccatatacctttccatcagg

SEQ ID NO: 310341 - DNA, 20 bp, Artificial Sequence
  Description of Artificial Sequence: Synthetic oligonucleotide
  Target: ATXN1; (+) strand; PAM type: YTN; PAM sequence: TTC
catatacctttccatcaggg

SEQ ID NO: 310342 - DNA, 20 bp, Artificial Sequence
  Description of Artificial Sequence: Synthetic oligonucleotide
  Target: ATXN1; (+) strand; PAM type: YTN; PAM sequence: CTT
tccatcagggagcttggtgc

SEQ ID NO: 310343 - DNA, 20 bp, Artificial Sequence
  Description of Artificial Sequence: Synthetic oligonucleotide
  Target: ATXN1; (+) strand; PAM type: YTN; PAM sequence: TTT
ccatcagggagcttggtgct

SEQ ID NO: 310344 - DNA, 20 bp, Artificial Sequence
  Description of Artificial Sequence: Synthetic oligonucleotide
  Target: ATXN1; (+) strand; PAM type: YTN; PAM sequence: TTC
catcagggagcttggtgctt

SEQ ID NO: 310345 - DNA, 20 bp, Artificial Sequence
  Description of Artificial Sequence: Synthetic oligonucleotide
  Target: ATXN1; (+) strand; PAM type: YTN; PAM sequence: CTT
ggtgcttgtagtagtttttg

SEQ ID NO: 310346 - DNA, 20 bp, Artificial Sequence
  Description of Artificial Sequence: Synthetic oligonucleotide
  Target: ATXN1; (+) strand; PAM type: YTN; PAM sequence: TTG
gtgcttgtagtagtttttgt

SEQ ID NO: 310347 - DNA, 20 bp, Artificial Sequence
  Description of Artificial Sequence: Synthetic oligonucleotide
  Target: ATXN1; (+) strand; PAM type: YTN; PAM sequence: CTT
gtagtagtttttgtgaggta

SEQ ID NO: 310348 - DNA, 20 bp, Artificial Sequence
  Description of Artificial Sequence: Synthetic oligonucleotide
  Target: ATXN1; (+) strand; PAM type: YTN; PAM sequence: TTG
tagtagtttttgtgaggtaa

SEQ ID NO: 310349 - DNA, 20 bp, Artificial Sequence
  Description of Artificial Sequence: Synthetic oligonucleotide
  Target: ATXN1; (+) strand; PAM type: YTN; PAM sequence: TTT
ttgtgaggtaaaacctatgc

SEQ ID NO: 310350 - DNA, 20 bp, Artificial Sequence
  Description of Artificial Sequence: Synthetic oligonucleotide
  Target: ATXN1; (+) strand; PAM type: YTN; PAM sequence: TTT
tgtgaggtaaaacctatgca

SEQ ID NO: 310351 - DNA, 20 bp, Artificial Sequence
  Description of Artificial Sequence: Synthetic oligonucleotide
  Target: ATXN1; (+) strand; PAM type: YTN; PAM sequence: TTT
gtgaggtaaaacctatgcat

SEQ ID NO: 310352 - DNA, 20 bp, Artificial Sequence
  Description of Artificial Sequence: Synthetic oligonucleotide
  Target: ATXN1; (+) strand; PAM type: YTN; PAM sequence: TTG
tgaggtaaaacctatgcata

SEQ ID NO: 310353 - DNA, 20 bp, Artificial Sequence
  Description of Artificial Sequence: Synthetic oligonucleotide
  Target: ATXN1; (+) strand; PAM type: YTN; PAM sequence: CTA
tgcatagaaacggaagaagt

SEQ ID NO: 310354 - DNA, 20 bp, Artificial Sequence
  Description of Artificial Sequence: Synthetic oligonucleotide
  Target: ATXN1; (+) strand; PAM type: YTN; PAM sequence: TTG
aggactcgatctgctaacgt

SEQ ID NO: 310355 - DNA, 20 bp, Artificial Sequence
  Description of Artificial Sequence: Synthetic oligonucleotide
  Target: ATXN1; (+) strand; PAM type: YTN; PAM sequence: CTC
gatctgctaacgtatttttt

SEQ ID NO: 310356 - DNA, 20 bp, Artificial Sequence
  Description of Artificial Sequence: Synthetic oligonucleotide
  Target: ATXN1; (+) strand; PAM type: YTN; PAM sequence: CTG
ctaacgtatttttttagccc

SEQ ID NO: 310357 - DNA, 20 bp, Artificial Sequence
  Description of Artificial Sequence: Synthetic oligonucleotide
  Target: ATXN1; (+) strand; PAM type: YTN; PAM sequence: CTA
acgtatttttttagccctat

SEQ ID NO: 310358 - DNA, 20 bp, Artificial Sequence
  Description of Artificial Sequence: Synthetic oligonucleotide
  Target: ATXN1; (+) strand; PAM type: YTN; PAM sequence: TTT
ttttagccctatccattaaa

SEQ ID NO: 310359 - DNA, 20 bp, Artificial Sequence
  Description of Artificial Sequence: Synthetic oligonucleotide
  Target: ATXN1; (+) strand; PAM type: YTN; PAM sequence: TTT
tttagccctatccattaaaa

SEQ ID NO: 310360 - DNA, 20 bp, Artificial Sequence
  Description of Artificial Sequence: Synthetic oligonucleotide
  Target: ATXN1; (+) strand; PAM type: YTN; PAM sequence: TTT
ttagccctatccattaaaat

SEQ ID NO: 310361 - DNA, 20 bp, Artificial Sequence
  Description of Artificial Sequence: Synthetic oligonucleotide
  Target: ATXN1; (+) strand; PAM type: YTN; PAM sequence: TTT
tagccctatccattaaaatt

SEQ ID NO: 310362 - DNA, 20 bp, Artificial Sequence
  Description of Artificial Sequence: Synthetic oligonucleotide
  Target: ATXN1; (+) strand; PAM type: YTN; PAM sequence: TTT
agccctatccattaaaatta

SEQ ID NO: 310363 - DNA, 20 bp, Artificial Sequence
  Description of Artificial Sequence: Synthetic oligonucleotide
  Target: ATXN1; (+) strand; PAM type: YTN; PAM sequence: TTA
gccctatccattaaaattat

SEQ ID NO: 310364 - DNA, 20 bp, Artificial Sequence
  Description of Artificial Sequence: Synthetic oligonucleotide
  Target: ATXN1; (+) strand; PAM type: YTN; PAM sequence: CTA
tccattaaaattatattctt

SEQ ID NO: 310365 - DNA, 20 bp, Artificial Sequence
  Description of Artificial Sequence: Synthetic oligonucleotide
  Target: ATXN1; (+) strand; PAM type: YTN; PAM sequence: TTA
aaattatattcttaaatacc

SEQ ID NO: 310366 - DNA, 20 bp, Artificial Sequence
  Description of Artificial Sequence: Synthetic oligonucleotide
  Target: ATXN1; (+) strand; PAM type: YTN; PAM sequence: TTA
tattcttaaataccggtaat

SEQ ID NO: 310367 - DNA, 20 bp, Artificial Sequence
  Description of Artificial Sequence: Synthetic oligonucleotide
  Target: ATXN1; (+) strand; PAM type: YTN; PAM sequence: TTC
ttaaataccggtaattacca

SEQ ID NO: 310368 - DNA, 20 bp, Artificial Sequence
  Description of Artificial Sequence: Synthetic oligonucleotide
  Target: ATXN1; (+) strand; PAM type: YTN; PAM sequence: CTT
aaataccggtaattaccaat

SEQ ID NO: 310369 - DNA, 20 bp, Artificial Sequence
  Description of Artificial Sequence: Synthetic oligonucleotide
  Target: ATXN1; (+) strand; PAM type: YTN; PAM sequence: TTA
aataccggtaattaccaatt

SEQ ID NO: 310370 - DNA, 20 bp, Artificial Sequence
  Description of Artificial Sequence: Synthetic oligonucleotide
  Target: ATXN1; (+) strand; PAM type: YTN; PAM sequence: TTA
ccaattatccacattaaaca

SEQ ID NO: 310371 - DNA, 20 bp, Artificial Sequence
  Description of Artificial Sequence: Synthetic oligonucleotide
  Target: ATXN1; (+) strand; PAM type: YTN; PAM sequence: TTA
tccacattaaacagaaaaaa

SEQ ID NO: 310372 - DNA, 20 bp, Artificial Sequence
  Description of Artificial Sequence: Synthetic oligonucleotide
  Target: ATXN1; (+) strand; PAM type: YTN; PAM sequence: TTA
aacagaaaaaaaaatttttt

SEQ ID NO: 310373 - DNA, 20 bp, Artificial Sequence
  Description of Artificial Sequence: Synthetic oligonucleotide
  Target: ATXN1; (+) strand; PAM type: YTN; PAM sequence: TTT
ttttaaaatcagtagcaggg

SEQ ID NO: 310374 - DNA, 20 bp, Artificial Sequence
  Description of Artificial Sequence: Synthetic oligonucleotide
  Target: ATXN1; (+) strand; PAM type: YTN; PAM sequence: TTT
tttaaaatcagtagcagggt

SEQ ID NO: 310375 - DNA, 20 bp, Artificial Sequence
  Description of Artificial Sequence: Synthetic oligonucleotide
  Target: ATXN1; (+) strand; PAM type: YTN; PAM sequence: TTT
ttaaaatcagtagcagggtt

SEQ ID NO: 310376 - DNA, 20 bp, Artificial Sequence
  Description of Artificial Sequence: Synthetic oligonucleotide
  Target: ATXN1; (+) strand; PAM type: YTN; PAM sequence: TTT
taaaatcagtagcagggtta

SEQ ID NO: 310377 - DNA, 20 bp, Artificial Sequence
  Description of Artificial Sequence: Synthetic oligonucleotide
  Target: ATXN1; (+) strand; PAM type: YTN; PAM sequence: TTT
aaaatcagtagcagggttac

SEQ ID NO: 310378 - DNA, 20 bp, Artificial Sequence
  Description of Artificial Sequence: Synthetic oligonucleotide
  Target: ATXN1; (+) strand; PAM type: YTN; PAM sequence: TTA
aaatcagtagcagggttact

SEQ ID NO: 310379 - DNA, 20 bp, Artificial Sequence
  Description of Artificial Sequence: Synthetic oligonucleotide
  Target: ATXN1; (+) strand; PAM type: YTN; PAM sequence: TTA
ctataaaatcatccccaaac

SEQ ID NO: 310380 - DNA, 20 bp, Artificial Sequence
  Description of Artificial Sequence: Synthetic oligonucleotide
  Target: ATXN1; (+) strand; PAM type: YTN; PAM sequence: CTA
taaaatcatccccaaactag

SEQ ID NO: 310381 - DNA, 20 bp, Artificial Sequence
  Description of Artificial Sequence: Synthetic oligonucleotide
  Target: ATXN1; (+) strand; PAM type: YTN; PAM sequence: CTA
gtgaatgctggactgatttt

SEQ ID NO: 310382 - DNA, 20 bp, Artificial Sequence
  Description of Artificial Sequence: Synthetic oligonucleotide
  Target: ATXN1; (+) strand; PAM type: YTN; PAM sequence: CTG
gactgattttcagtctttga

SEQ ID NO: 310383 - DNA, 20 bp, Artificial Sequence
  Description of Artificial Sequence: Synthetic oligonucleotide
  Target: ATXN1; (+) strand; PAM type: YTN; PAM sequence: CTG
attttcagtctttgattact

SEQ ID NO: 310384 - DNA, 20 bp, Artificial Sequence
  Description of Artificial Sequence: Synthetic oligonucleotide
  Target: ATXN1; (+) strand; PAM type: YTN; PAM sequence: TTT
tcagtctttgattactggag

SEQ ID NO: 310385 - DNA, 20 bp, Artificial Sequence
  Description of Artificial Sequence: Synthetic oligonucleotide
  Target: ATXN1; (+) strand; PAM type: YTN; PAM sequence: TTT
cagtctttgattactggagc

SEQ ID NO: 310386 - DNA, 20 bp, Artificial Sequence
  Description of Artificial Sequence: Synthetic oligonucleotide
  Target: ATXN1; (+) strand; PAM type: YTN; PAM sequence: TTC
agtctttgattactggagct

SEQ ID NO: 310387 - DNA, 20 bp, Artificial Sequence
  Description of Artificial Sequence: Synthetic oligonucleotide
  Target: ATXN1; (+) strand; PAM type: YTN; PAM sequence: CTT
tgattactggagctgatctg

SEQ ID NO: 310388 - DNA, 20 bp, Artificial Sequence
  Description of Artificial Sequence: Synthetic oligonucleotide
  Target: ATXN1; (+) strand; PAM type: YTN; PAM sequence: TTT
gattactggagctgatctgc

SEQ ID NO: 310389 - DNA, 20 bp, Artificial Sequence
  Description of Artificial Sequence: Synthetic oligonucleotide
  Target: ATXN1; (+) strand; PAM type: YTN; PAM sequence: TTG
attactggagctgatctgca

SEQ ID NO: 310390 - DNA, 20 bp, Artificial Sequence
  Description of Artificial Sequence: Synthetic oligonucleotide
  Target: ATXN1; (+) strand; PAM type: YTN; PAM sequence: TTA
ctggagctgatctgcacatt

SEQ ID NO: 310391 - DNA, 20 bp, Artificial Sequence
  Description of Artificial Sequence: Synthetic oligonucleotide
  Target: ATXN1; (+) strand; PAM type: YTN; PAM sequence: CTG
gagctgatctgcacatttgc

SEQ ID NO: 310392 - DNA, 20 bp, Artificial Sequence
  Description of Artificial Sequence: Synthetic oligonucleotide
  Target: ATXN1; (+) strand; PAM type: YTN; PAM sequence: CTG
atctgcacatttgcttaggc

SEQ ID NO: 310393 - DNA, 20 bp, Artificial Sequence
  Description of Artificial Sequence: Synthetic oligonucleotide
  Target: ATXN1; (+) strand; PAM type: YTN; PAM sequence: CTG
cacatttgcttaggctgatt

SEQ ID NO: 310394 - DNA, 20 bp, Artificial Sequence
  Description of Artificial Sequence: Synthetic oligonucleotide
  Target: ATXN1; (+) strand; PAM type: YTN; PAM sequence: TTT
gcttaggctgattttaaact

SEQ ID NO: 310395 - DNA, 20 bp, Artificial Sequence
  Description of Artificial Sequence: Synthetic oligonucleotide
  Target: ATXN1; (+) strand; PAM type: YTN; PAM sequence: TTG
cttaggctgattttaaactt

SEQ ID NO: 310396 - DNA, 20 bp, Artificial Sequence
  Description of Artificial Sequence: Synthetic oligonucleotide
  Target: ATXN1; (+) strand; PAM type: YTN; PAM sequence: CTT
aggctgattttaaacttagt

SEQ ID NO: 310397 - DNA, 20 bp, Artificial Sequence
  Description of Artificial Sequence: Synthetic oligonucleotide
  Target: ATXN1; (+) strand; PAM type: YTN; PAM sequence: TTA
ggctgattttaaacttagtt

SEQ ID NO: 310398 - DNA, 20 bp, Artificial Sequence
  Description of Artificial Sequence: Synthetic oligonucleotide
  Target: ATXN1; (+) strand; PAM type: YTN; PAM sequence: CTG
attttaaacttagtttgggt

SEQ ID NO: 310399 - DNA, 20 bp, Artificial Sequence
  Description of Artificial Sequence: Synthetic oligonucleotide
  Target: ATXN1; (+) strand; PAM type: YTN; PAM sequence: TTT
taaacttagtttgggtttcc

SEQ ID NO: 310400 - DNA, 20 bp, Artificial Sequence
  Description of Artificial Sequence: Synthetic oligonucleotide
  Target: ATXN1; (+) strand; PAM type: YTN; PAM sequence: TTT
aaacttagtttgggtttcct

SEQ ID NO: 310401 - DNA, 20 bp, Artificial Sequence
  Description of Artificial Sequence: Synthetic oligonucleotide
  Target: ATXN1; (+) strand; PAM type: YTN; PAM sequence: TTA
aacttagtttgggtttccta

SEQ ID NO: 310402 - DNA, 20 bp, Artificial Sequence
  Description of Artificial Sequence: Synthetic oligonucleotide
  Target: ATXN1; (+) strand; PAM type: YTN; PAM sequence: CTT
agtttgggtttcctaagctc

SEQ ID NO: 310403 - DNA, 20 bp, Artificial Sequence
  Description of Artificial Sequence: Synthetic oligonucleotide
  Target: ATXN1; (+) strand; PAM type: YTN; PAM sequence: TTA
gtttgggtttcctaagctca

SEQ ID NO: 310404 - DNA, 20 bp, Artificial Sequence
  Description of Artificial Sequence: Synthetic oligonucleotide
  Target: ATXN1; (+) strand; PAM type: YTN; PAM sequence: TTT
gggtttcctaagctcacgcc

SEQ ID NO: 310405 - DNA, 20 bp, Artificial Sequence
  Description of Artificial Sequence: Synthetic oligonucleotide
  Target: ATXN1; (+) strand; PAM type: YTN; PAM sequence: TTG
ggtttcctaagctcacgcca

SEQ ID NO: 310406 - DNA, 20 bp, Artificial Sequence
  Description of Artificial Sequence: Synthetic oligonucleotide
  Target: ATXN1; (+) strand; PAM type: YTN; PAM sequence: TTT
cctaagctcacgccaggtaa

SEQ ID NO: 310407 - DNA, 20 bp, Artificial Sequence
  Description of Artificial Sequence: Synthetic oligonucleotide
  Target: ATXN1; (+) strand; PAM type: YTN; PAM sequence: TTC
ctaagctcacgccaggtaac

SEQ ID NO: 310408 - DNA, 20 bp, Artificial Sequence
  Description of Artificial Sequence: Synthetic oligonucleotide
  Target: ATXN1; (+) strand; PAM type: YTN; PAM sequence: CTA
agctcacgccaggtaacagt

SEQ ID NO: 310409 - DNA, 20 bp, Artificial Sequence
  Description of Artificial Sequence: Synthetic oligonucleotide
  Target: ATXN1; (+) strand; PAM type: YTN; PAM sequence: CTC
acgccaggtaacagtaggaa

SEQ ID NO: 310410 - DNA, 20 bp, Artificial Sequence
  Description of Artificial Sequence: Synthetic oligonucleotide
  Target: ATXN1; (+) strand; PAM type: YTN; PAM sequence: TTT
atattggatgtcagaaagaa

SEQ ID NO: 310411 - DNA, 20 bp, Artificial Sequence
  Description of Artificial Sequence: Synthetic oligonucleotide
  Target: ATXN1; (+) strand; PAM type: YTN; PAM sequence: TTA
tattggatgtcagaaagaaa

SEQ ID NO: 310412 - DNA, 20 bp, Artificial Sequence
  Description of Artificial Sequence: Synthetic oligonucleotide
  Target: ATXN1; (+) strand; PAM type: YTN; PAM sequence: TTG
gatgtcagaaagaaactatt

SEQ ID NO: 310413 - DNA, 20 bp, Artificial Sequence
  Description of Artificial Sequence: Synthetic oligonucleotide
  Target: ATXN1; (+) strand; PAM type: YTN; PAM sequence: CTA
ttctggagctatgaatatga

SEQ ID NO: 310414 - DNA, 20 bp, Artificial Sequence
  Description of Artificial Sequence: Synthetic oligonucleotide
  Target: ATXN1; (+) strand; PAM type: YTN; PAM sequence: TTC
tggagctatgaatatgatct

SEQ ID NO: 310415 - DNA, 20 bp, Artificial Sequence
  Description of Artificial Sequence: Synthetic oligonucleotide
  Target: ATXN1; (+) strand; PAM type: YTN; PAM sequence: CTG
gagctatgaatatgatctcc

SEQ ID NO: 310416 - DNA, 20 bp, Artificial Sequence
  Description of Artificial Sequence: Synthetic oligonucleotide
  Target: ATXN1; (+) strand; PAM type: YTN; PAM sequence: CTA
tgaatatgatctccaatgtg

SEQ ID NO: 310417 - DNA, 20 bp, Artificial Sequence
  Description of Artificial Sequence: Synthetic oligonucleotide
  Target: ATXN1; (+) strand; PAM type: YTN; PAM sequence: CTC
caatgtgaataatccgtaaa

SEQ ID NO: 310418 - DNA, 20 bp, Artificial Sequence
  Description of Artificial Sequence: Synthetic oligonucleotide
  Target: ATXN1; (+) strand; PAM type: YTN; PAM sequence: TTA
tccttgggtacatggcaaca

SEQ ID NO: 310419 - DNA, 20 bp, Artificial Sequence
  Description of Artificial Sequence: Synthetic oligonucleotide
  Target: ATXN1; (+) strand; PAM type: YTN; PAM sequence: CTT
gggtacatggcaacacatct

SEQ ID NO: 310420 - DNA, 20 bp, Artificial Sequence
  Description of Artificial Sequence: Synthetic oligonucleotide
  Target: ATXN1; (+) strand; PAM type: YTN; PAM sequence: TTG
ggtacatggcaacacatctc

SEQ ID NO: 310421 - DNA, 20 bp, Artificial Sequence
  Description of Artificial Sequence: Synthetic oligonucleotide
  Target: ATXN1; (+) strand; PAM type: YTN; PAM sequence: CTC
ggtactcatgattattttca

SEQ ID NO: 310422 - DNA, 20 bp, Artificial Sequence
  Description of Artificial Sequence: Synthetic oligonucleotide
  Target: ATXN1; (+) strand; PAM type: YTN; PAM sequence: CTC
atgattattttcatccatac

SEQ ID NO: 310423 - DNA, 20 bp, Artificial Sequence
  Description of Artificial Sequence: Synthetic oligonucleotide
  Target: ATXN1; (+) strand; PAM type: YTN; PAM sequence: TTA
ttttcatccatacacactca

SEQ ID NO: 310424 - DNA, 20 bp, Artificial Sequence
  Description of Artificial Sequence: Synthetic oligonucleotide
  Target: ATXN1; (+) strand; PAM type: YTN; PAM sequence: TTT
tcatccatacacactcacta

SEQ ID NO: 310425 - DNA, 20 bp, Artificial Sequence
  Description of Artificial Sequence: Synthetic oligonucleotide
  Target: ATXN1; (+) strand; PAM type: YTN; PAM sequence: TTT
catccatacacactcactat

SEQ ID NO: 310426 - DNA, 20 bp, Artificial Sequence
  Description of Artificial Sequence: Synthetic oligonucleotide
  Target: ATXN1; (+) strand; PAM type: YTN; PAM sequence: TTC
atccatacacactcactatt

SEQ ID NO: 310427 - DNA, 20 bp, Artificial Sequence
  Description of Artificial Sequence: Synthetic oligonucleotide
  Target: ATXN1; (+) strand; PAM type: YTN; PAM sequence: CTC
actatttttaagagcacagc

SEQ ID NO: 310428 - DNA, 20 bp, Artificial Sequence
  Description of Artificial Sequence: Synthetic oligonucleotide
  Target: ATXN1; (+) strand; PAM type: YTN; PAM sequence: CTA
tttttaagagcacagcccag

SEQ ID NO: 310429 - DNA, 20 bp, Artificial Sequence
  Description of Artificial Sequence: Synthetic oligonucleotide
  Target: ATXN1; (+) strand; PAM type: YTN; PAM sequence: TTT
ttaagagcacagcccagctg

SEQ ID NO: 310430 - DNA, 20 bp, Artificial Sequence
  Description of Artificial Sequence: Synthetic oligonucleotide
  Target: ATXN1; (+) strand; PAM type: YTN; PAM sequence: TTT
taagagcacagcccagctgg

SEQ ID NO: 310431 - DNA, 20 bp, Artificial Sequence
  Description of Artificial Sequence: Synthetic oligonucleotide
  Target: ATXN1; (+) strand; PAM type: YTN; PAM sequence: TTT
aagagcacagcccagctgga

SEQ ID NO: 310432 - DNA, 20 bp, Artificial Sequence
  Description of Artificial Sequence: Synthetic oligonucleotide
  Target: ATXN1; (+) strand; PAM type: YTN; PAM sequence: TTA
agagcacagcccagctggaa

SEQ ID NO: 310433 - DNA, 20 bp, Artificial Sequence
  Description of Artificial Sequence: Synthetic oligonucleotide
  Target: ATXN1; (+) strand; PAM type: YTN; PAM sequence: CTG
gaaaggaaaataacttccac

SEQ ID NO: 310434 - DNA, 20 bp, Artificial Sequence
  Description of Artificial Sequence: Synthetic oligonucleotide
  Target: ATXN1; (+) strand; PAM type: YTN; PAM sequence: CTT
ccacttctttccagcacttt

SEQ ID NO: 310435 - DNA, 20 bp, Artificial Sequence
  Description of Artificial Sequence: Synthetic oligonucleotide
  Target: ATXN1; (+) strand; PAM type: YTN; PAM sequence: TTC
cacttctttccagcactttt

SEQ ID NO: 310436 - DNA, 20 bp, Artificial Sequence
  Description of Artificial Sequence: Synthetic oligonucleotide
  Target: ATXN1; (+) strand; PAM type: YTN; PAM sequence: CTT
ctttccagcacttttcaaag

SEQ ID NO: 310437 - DNA, 20 bp, Artificial Sequence
  Description of Artificial Sequence: Synthetic oligonucleotide
  Target: ATXN1; (+) strand; PAM type: YTN; PAM sequence: TTC
tttccagcacttttcaaagt

SEQ ID NO: 310438 - DNA, 20 bp, Artificial Sequence
  Description of Artificial Sequence: Synthetic oligonucleotide
  Target: ATXN1; (+) strand; PAM type: YTN; PAM sequence: CTT
tccagcacttttcaaagtaa

SEQ ID NO: 310439 - DNA, 20 bp, Artificial Sequence
  Description of Artificial Sequence: Synthetic oligonucleotide
  Target: ATXN1; (+) strand; PAM type: YTN; PAM sequence: TTT
ccagcacttttcaaagtaat

SEQ ID NO: 310440 - DNA, 20 bp, Artificial Sequence
  Description of Artificial Sequence: Synthetic oligonucleotide
  Target: ATXN1; (+) strand; PAM type: YTN; PAM sequence: TTC
cagcacttttcaaagtaatg

SEQ ID NO: 310441 - DNA, 20 bp, Artificial Sequence
  Description of Artificial Sequence: Synthetic oligonucleotide
  Target: ATXN1; (+) strand; PAM type: YTN; PAM sequence: CTT
ttcaaagtaatgaacagtag

SEQ ID NO: 310442 - DNA, 20 bp, Artificial Sequence
  Description of Artificial Sequence: Synthetic oligonucleotide
  Target: ATXN1; (+) strand; PAM type: YTN; PAM sequence: TTT
tcaaagtaatgaacagtagc

SEQ ID NO: 310443 - DNA, 20 bp, Artificial Sequence
  Description of Artificial Sequence: Synthetic oligonucleotide
  Target: ATXN1; (+) strand; PAM type: YTN; PAM sequence: TTT
caaagtaatgaacagtagcc

SEQ ID NO: 310444 - DNA, 20 bp, Artificial Sequence
  Description of Artificial Sequence: Synthetic oligonucleotide
  Target: ATXN1; (+) strand; PAM type: YTN; PAM sequence: TTC
aaagtaatgaacagtagcca

SEQ ID NO: 310445 - DNA, 20 bp, Artificial Sequence
  Description of Artificial Sequence: Synthetic oligonucleotide
  Target: ATXN1; (+) strand; PAM type: YTN; PAM sequence: TTC
ttacttctaactaatccatt

SEQ ID NO: 310446 - DNA, 20 bp, Artificial Sequence
  Description of Artificial Sequence: Synthetic oligonucleotide
  Target: ATXN1; (+) strand; PAM type: YTN; PAM sequence: CTT
acttctaactaatccattca

SEQ ID NO: 310447 - DNA, 20 bp, Artificial Sequence
  Description of Artificial Sequence: Synthetic oligonucleotide
  Target: ATXN1; (+) strand; PAM type: YTN; PAM sequence: TTA
cttctaactaatccattcac

SEQ ID NO: 310448 - DNA, 20 bp, Artificial Sequence
  Description of Artificial Sequence: Synthetic oligonucleotide
  Target: ATXN1; (+) strand; PAM type: YTN; PAM sequence: CTT
ctaactaatccattcaccaa

SEQ ID NO: 310449 - DNA, 20 bp, Artificial Sequence
  Description of Artificial Sequence: Synthetic oligonucleotide
  Target: ATXN1; (+) strand; PAM type: YTN; PAM sequence: TTC
taactaatccattcaccaag

SEQ ID NO: 310450 - DNA, 20 bp, Artificial Sequence
  Description of Artificial Sequence: Synthetic oligonucleotide
  Target: ATXN1; (+) strand; PAM type: YTN; PAM sequence: CTA
actaatccattcaccaagca

SEQ ID NO: 310451 - DNA, 20 bp, Artificial Sequence
  Description of Artificial Sequence: Synthetic oligonucleotide
  Target: ATXN1; (+) strand; PAM type: YTN; PAM sequence: CTA
atccattcaccaagcattta

SEQ ID NO: 310452 - DNA, 20 bp, Artificial Sequence
  Description of Artificial Sequence: Synthetic oligonucleotide
  Target: ATXN1; (+) strand; PAM type: YTN; PAM sequence: TTC
accaagcatttatttaagca

SEQ ID NO: 310453 - DNA, 20 bp, Artificial Sequence
  Description of Artificial Sequence: Synthetic oligonucleotide
  Target: ATXN1; (+) strand; PAM type: YTN; PAM sequence: TTT
atttaagcattgattgcctg

SEQ ID NO: 310454 - DNA, 20 bp, Artificial Sequence
  Description of Artificial Sequence: Synthetic oligonucleotide
  Target: ATXN1; (+) strand; PAM type: YTN; PAM sequence: TTA
tttaagcattgattgcctgc

SEQ ID NO: 310455 - DNA, 20 bp, Artificial Sequence
  Description of Artificial Sequence: Synthetic oligonucleotide
  Target: ATXN1; (+) strand; PAM type: YTN; PAM sequence: TTT
aagcattgattgcctgccga

SEQ ID NO: 310456 - DNA, 20 bp, Artificial Sequence
  Description of Artificial Sequence: Synthetic oligonucleotide
  Target: ATXN1; (+) strand; PAM type: YTN; PAM sequence: TTA
agcattgattgcctgccgag

SEQ ID NO: 310457 - DNA, 20 bp, Artificial Sequence
  Description of Artificial Sequence: Synthetic oligonucleotide
  Target: ATXN1; (+) strand; PAM type: YTN; PAM sequence: TTG
attgcctgccgaggactgat

SEQ ID NO: 310458 - DNA, 20 bp, Artificial Sequence
  Description of Artificial Sequence: Synthetic oligonucleotide
  Target: ATXN1; (+) strand; PAM type: YTN; PAM sequence: TTG
cctgccgaggactgatatgc

SEQ ID NO: 310459 - DNA, 20 bp, Artificial Sequence
  Description of Artificial Sequence: Synthetic oligonucleotide
  Target: ATXN1; (+) strand; PAM type: YTN; PAM sequence: CTG
ccgaggactgatatgcaaaa

SEQ ID NO: 310460 - DNA, 20 bp, Artificial Sequence
  Description of Artificial Sequence: Synthetic oligonucleotide
  Target: ATXN1; (+) strand; PAM type: YTN; PAM sequence: CTG
atatgcaaaagaaggaattc

SEQ ID NO: 310461 - DNA, 20 bp, Artificial Sequence
  Description of Artificial Sequence: Synthetic oligonucleotide
  Target: ATXN1; (+) strand; PAM type: YTN; PAM sequence: TTC
ttgtagtccttggtttcccc

SEQ ID NO: 310462 - DNA, 20 bp, Artificial Sequence
  Description of Artificial Sequence: Synthetic oligonucleotide
  Target: ATXN1; (+) strand; PAM type: YTN; PAM sequence: CTT
gtagtccttggtttccccac

SEQ ID NO: 310463 - DNA, 20 bp, Artificial Sequence
  Description of Artificial Sequence: Synthetic oligonucleotide
  Target: ATXN1; (+) strand; PAM type: YTN; PAM sequence: TTG
tagtccttggtttccccaca

SEQ ID NO: 310464 - DNA, 20 bp, Artificial Sequence
  Description of Artificial Sequence: Synthetic oligonucleotide
  Target: ATXN1; (+) strand; PAM type: YTN; PAM sequence: CTT
ggtttccccacatgtgatct

SEQ ID NO: 310465 - DNA, 20 bp, Artificial Sequence
  Description of Artificial Sequence: Synthetic oligonucleotide
  Target: ATXN1; (+) strand; PAM type: YTN; PAM sequence: TTG
gtttccccacatgtgatctg

SEQ ID NO: 310466 - DNA, 20 bp, Artificial Sequence
  Description of Artificial Sequence: Synthetic oligonucleotide
  Target: ATXN1; (+) strand; PAM type: YTN; PAM sequence: TTT
ccccacatgtgatctgtgcg

SEQ ID NO: 310467 - DNA, 20 bp, Artificial Sequence
  Description of Artificial Sequence: Synthetic oligonucleotide
  Target: ATXN1; (+) strand; PAM type: YTN; PAM sequence: TTC
cccacatgtgatctgtgcgt

SEQ ID NO: 310468 - DNA, 20 bp, Artificial Sequence
  Description of Artificial Sequence: Synthetic oligonucleotide
  Target: ATXN1; (+) strand; PAM type: YTN; PAM sequence: CTG
tgcgtacagagaaggaaggt

SEQ ID NO: 310469 - DNA, 20 bp, Artificial Sequence
  Description of Artificial Sequence: Synthetic oligonucleotide
  Target: ATXN1; (+) strand; PAM type: YTN; PAM sequence: CTG
ttatacactataaggtcttt

SEQ ID NO: 310470 - DNA, 20 bp, Artificial Sequence
  Description of Artificial Sequence: Synthetic oligonucleotide
  Target: ATXN1; (+) strand; PAM type: YTN; PAM sequence: TTA
tacactataaggtctttcag

SEQ ID NO: 310471 - DNA, 20 bp, Artificial Sequence
  Description of Artificial Sequence: Synthetic oligonucleotide
  Target: ATXN1; (+) strand; PAM type: YTN; PAM sequence: CTA
taaggtctttcagatcttta

SEQ ID NO: 310472 - DNA, 20 bp, Artificial Sequence
  Description of Artificial Sequence: Synthetic oligonucleotide
  Target: ATXN1; (+) strand; PAM type: YTN; PAM sequence: CTT
tcagatctttagaaggcaca

SEQ ID NO: 310473 - DNA, 20 bp, Artificial Sequence
  Description of Artificial Sequence: Synthetic oligonucleotide
  Target: ATXN1; (+) strand; PAM type: YTN; PAM sequence: TTT
cagatctttagaaggcacag

SEQ ID NO: 310474 - DNA, 20 bp, Artificial Sequence
  Description of Artificial Sequence: Synthetic oligonucleotide
  Target: ATXN1; (+) strand; PAM type: YTN; PAM sequence: TTC
agatctttagaaggcacagt

SEQ ID NO: 310475 - DNA, 20 bp, Artificial Sequence
  Description of Artificial Sequence: Synthetic oligonucleotide
  Target: ATXN1; (+) strand; PAM type: YTN; PAM sequence: CTT
tagaaggcacagtccctcca

SEQ ID NO: 310476 - DNA, 20 bp, Artificial Sequence
  Description of Artificial Sequence: Synthetic oligonucleotide
  Target: ATXN1; (+) strand; PAM type: YTN; PAM sequence: TTT
agaaggcacagtccctccac

SEQ ID NO: 310477 - DNA, 20 bp, Artificial Sequence
  Description of Artificial Sequence: Synthetic oligonucleotide
  Target: ATXN1; (+) strand; PAM type: YTN; PAM sequence: TTA
gaaggcacagtccctccacc

SEQ ID NO: 310478 - DNA, 20 bp, Artificial Sequence
  Description of Artificial Sequence: Synthetic oligonucleotide
  Target: ATXN1; (+) strand; PAM type: YTN; PAM sequence: CTC
caccaagaagcctgttgagt

SEQ ID NO: 310479 - DNA, 20 bp, Artificial Sequence
  Description of Artificial Sequence: Synthetic oligonucleotide
  Target: ATXN1; (+) strand; PAM type: YTN; PAM sequence: CTG
ttgagttacaaatataaata

SEQ ID NO: 310480 - DNA, 20 bp, Artificial Sequence
  Description of Artificial Sequence: Synthetic oligonucleotide
  Target: ATXN1; (+) strand; PAM type: YTN; PAM sequence: TTG
agttacaaatataaataatg

SEQ ID NO: 310481 - DNA, 20 bp, Artificial Sequence
  Description of Artificial Sequence: Synthetic oligonucleotide
  Target: ATXN1; (+) strand; PAM type: YTN; PAM sequence: TTA
caaatataaataatggccaa

SEQ ID NO: 310482 - DNA, 20 bp, Artificial Sequence
  Description of Artificial Sequence: Synthetic oligonucleotide
  Target: ATXN1; (+) strand; PAM type: YTN; PAM sequence: TTA
agtagaagttgacaaaattc

SEQ ID NO: 310483 - DNA, 20 bp, Artificial Sequence
  Description of Artificial Sequence: Synthetic oligonucleotide
  Target: ATXN1; (+) strand; PAM type: YTN; PAM sequence: TTG
acaaaattctatttaatctt

SEQ ID NO: 310484 - DNA, 20 bp, Artificial Sequence
  Description of Artificial Sequence: Synthetic oligonucleotide
  Target: ATXN1; (+) strand; PAM type: YTN; PAM sequence: TTC
tatttaatcttagtacttct

SEQ ID NO: 310485 - DNA, 20 bp, Artificial Sequence
  Description of Artificial Sequence: Synthetic oligonucleotide
  Target: ATXN1; (+) strand; PAM type: YTN; PAM sequence: CTA
tttaatcttagtacttcttt

SEQ ID NO: 310486 - DNA, 20 bp, Artificial Sequence
  Description of Artificial Sequence: Synthetic oligonucleotide
  Target: ATXN1; (+) strand; PAM type: YTN; PAM sequence: TTT
aatcttagtacttctttaag

SEQ ID NO: 310487 - DNA, 20 bp, Artificial Sequence
  Description of Artificial Sequence: Synthetic oligonucleotide
  Target: ATXN1; (+) strand; PAM type: YTN; PAM sequence: TTA
atcttagtacttctttaagg

SEQ ID NO: 310488 - DNA, 20 bp, Artificial Sequence
  Description of Artificial Sequence: Synthetic oligonucleotide
  Target: ATXN1; (+) strand; PAM type: YTN; PAM sequence: CTT
agtacttctttaaggatgag

SEQ ID NO: 310489 - DNA, 20 bp, Artificial Sequence
  Description of Artificial Sequence: Synthetic oligonucleotide
  Target: ATXN1; (+) strand; PAM type: YTN; PAM sequence: TTA
gtacttctttaaggatgagg

SEQ ID NO: 310490 - DNA, 20 bp, Artificial Sequence
  Description of Artificial Sequence: Synthetic oligonucleotide
  Target: ATXN1; (+) strand; PAM type: YTN; PAM sequence: CTT
ctttaaggatgaggaagcag

SEQ ID NO: 310491 - DNA, 20 bp, Artificial Sequence
  Description of Artificial Sequence: Synthetic oligonucleotide
  Target: ATXN1; (+) strand; PAM type: YTN; PAM sequence: TTC
tttaaggatgaggaagcagg

SEQ ID NO: 310492 - DNA, 20 bp, Artificial Sequence
  Description of Artificial Sequence: Synthetic oligonucleotide
  Target: ATXN1; (+) strand; PAM type: YTN; PAM sequence: CTT
taaggatgaggaagcaggga

SEQ ID NO: 310493 - DNA, 20 bp, Artificial Sequence
  Description of Artificial Sequence: Synthetic oligonucleotide
  Target: ATXN1; (+) strand; PAM type: YTN; PAM sequence: TTT
aaggatgaggaagcagggag

SEQ ID NO: 310494 - DNA, 20 bp, Artificial Sequence
  Description of Artificial Sequence: Synthetic oligonucleotide
  Target: ATXN1; (+) strand; PAM type: YTN; PAM sequence: TTA
aggatgaggaagcagggagg

SEQ ID NO: 310495 - DNA, 20 bp, Artificial Sequence
  Description of Artificial Sequence: Synthetic oligonucleotide
  Target: ATXN1; (+) strand; PAM type: YTN; PAM sequence: CTC
aaattaagcatcaaaatact

SEQ ID NO: 310496 - DNA, 20 bp, Artificial Sequence
  Description of Artificial Sequence: Synthetic oligonucleotide
  Target: ATXN1; (+) strand; PAM type: YTN; PAM sequence: TTA
agcatcaaaatacttgattc

SEQ ID NO: 310497 - DNA, 20 bp, Artificial Sequence
  Description of Artificial Sequence: Synthetic oligonucleotide
  Target: ATXN1; (+) strand; PAM type: YTN; PAM sequence: CTT
gattctcaaatgaggtgcag

SEQ ID NO: 310498 - DNA, 20 bp, Artificial Sequence
  Description of Artificial Sequence: Synthetic oligonucleotide
  Target: ATXN1; (+) strand; PAM type: YTN; PAM sequence: TTG
attctcaaatgaggtgcagg

SEQ ID NO: 310499 - DNA, 20 bp, Artificial Sequence
  Description of Artificial Sequence: Synthetic oligonucleotide
  Target: ATXN1; (+) strand; PAM type: YTN; PAM sequence: TTC
tcaaatgaggtgcaggtacc

SEQ ID NO: 310500 - DNA, 20 bp, Artificial Sequence
  Description of Artificial Sequence: Synthetic oligonucleotide
  Target: ATXN1; (+) strand; PAM type: YTN; PAM sequence: CTC
aaatgaggtgcaggtaccat

SEQ ID NO: 310501 - DNA, 20 bp, Artificial Sequence
  Description of Artificial Sequence: Synthetic oligonucleotide
  Target: ATXN1; (+) strand; PAM type: YTN; PAM sequence: TTT
acagacagtgctttttatga

SEQ ID NO: 310502 - DNA, 20 bp, Artificial Sequence
  Description of Artificial Sequence: Synthetic oligonucleotide
  Target: ATXN1; (+) strand; PAM type: YTN; PAM sequence: TTA
cagacagtgctttttatgag

SEQ ID NO: 310503 - DNA, 20 bp, Artificial Sequence
  Description of Artificial Sequence: Synthetic oligonucleotide
  Target: ATXN1; (+) strand; PAM type: YTN; PAM sequence: CTT
tttatgagctcaccagttgg

SEQ ID NO: 310504 - DNA, 20 bp, Artificial Sequence
  Description of Artificial Sequence: Synthetic oligonucleotide
  Target: ATXN1; (+) strand; PAM type: YTN; PAM sequence: TTT
ttatgagctcaccagttggg

SEQ ID NO: 310505 - DNA, 20 bp, Artificial Sequence
  Description of Artificial Sequence: Synthetic oligonucleotide
  Target: ATXN1; (+) strand; PAM type: YTN; PAM sequence: TTT
tatgagctcaccagttggga

SEQ ID NO: 310506 - DNA, 20 bp, Artificial Sequence
  Description of Artificial Sequence: Synthetic oligonucleotide
  Target: ATXN1; (+) strand; PAM type: YTN; PAM sequence: TTT
atgagctcaccagttgggag

SEQ ID NO: 310507 - DNA, 20 bp, Artificial Sequence
  Description of Artificial Sequence: Synthetic oligonucleotide
  Target: ATXN1; (+) strand; PAM type: YTN; PAM sequence: TTA
tgagctcaccagttgggaga

SEQ ID NO: 310508 - DNA, 20 bp, Artificial Sequence
  Description of Artificial Sequence: Synthetic oligonucleotide
  Target: ATXN1; (+) strand; PAM type: YTN; PAM sequence: CTC
accagttgggagagtgtttg

SEQ ID NO: 310509 - DNA, 20 bp, Artificial Sequence
  Description of Artificial Sequence: Synthetic oligonucleotide
  Target: ATXN1; (+) strand; PAM type: YTN; PAM sequence: TTG
ggagagtgtttgcctatatg

SEQ ID NO: 310510 - DNA, 20 bp, Artificial Sequence
  Description of Artificial Sequence: Synthetic oligonucleotide
  Target: ATXN1; (+) strand; PAM type: YTN; PAM sequence: TTT
gcctatatgacaatgtgtgt

SEQ ID NO: 310511 - DNA, 20 bp, Artificial Sequence
  Description of Artificial Sequence: Synthetic oligonucleotide
  Target: ATXN1; (+) strand; PAM type: YTN; PAM sequence: TTG
cctatatgacaatgtgtgtg

SEQ ID NO: 310512 - DNA, 20 bp, Artificial Sequence
  Description of Artificial Sequence: Synthetic oligonucleotide
  Target: ATXN1; (+) strand; PAM type: YTN; PAM sequence: CTA
tatgacaatgtgtgtgcaca

SEQ ID NO: 310513 - DNA, 20 bp, Artificial Sequence
  Description of Artificial Sequence: Synthetic oligonucleotide
  Target: ATXN1; (+) strand; PAM type: YTN; PAM sequence: CTG
tttacatatcacctggcaga

SEQ ID NO: 310514 - DNA, 20 bp, Artificial Sequence
  Description of Artificial Sequence: Synthetic oligonucleotide
  Target: ATXN1; (+) strand; PAM type: YTN; PAM sequence: TTT
acatatcacctggcagataa

SEQ ID NO: 310515 - DNA, 20 bp, Artificial Sequence
  Description of Artificial Sequence: Synthetic oligonucleotide
  Target: ATXN1; (+) strand; PAM type: YTN; PAM sequence: TTA
catatcacctggcagataag

SEQ ID NO: 310516 - DNA, 20 bp, Artificial Sequence
  Description of Artificial Sequence: Synthetic oligonucleotide
  Target: ATXN1; (+) strand; PAM type: YTN; PAM sequence: CTG
gcagataaggttttatagag

SEQ ID NO: 310517 - DNA, 20 bp, Artificial Sequence
  Description of Artificial Sequence: Synthetic oligonucleotide
  Target: ATXN1; (+) strand; PAM type: YTN; PAM sequence: TTT
tatagagtccaagttacaac

SEQ ID NO: 310518 - DNA, 20 bp, Artificial Sequence
  Description of Artificial Sequence: Synthetic oligonucleotide
  Target: ATXN1; (+) strand; PAM type: YTN; PAM sequence: TTT
atagagtccaagttacaacc

SEQ ID NO: 310519 - DNA, 20 bp, Artificial Sequence
  Description of Artificial Sequence: Synthetic oligonucleotide
  Target: ATXN1; (+) strand; PAM type: YTN; PAM sequence: TTA
tagagtccaagttacaacct

SEQ ID NO: 310520 - DNA, 20 bp, Artificial Sequence
  Description of Artificial Sequence: Synthetic oligonucleotide
  Target: ATXN1; (+) strand; PAM type: YTN; PAM sequence: TTA
caacctcctcctagtttgct

SEQ ID NO: 310521 - DNA, 20 bp, Artificial Sequence
  Description of Artificial Sequence: Synthetic oligonucleotide
  Target: ATXN1; (+) strand; PAM type: YTN; PAM sequence: CTC
ctcctagtttgctgaagtgc

SEQ ID NO: 310522 - DNA, 20 bp, Artificial Sequence
  Description of Artificial Sequence: Synthetic oligonucleotide
  Target: ATXN1; (+) strand; PAM type: YTN; PAM sequence: CTC
ctagtttgctgaagtgcaga

SEQ ID NO: 310523 - DNA, 20 bp, Artificial Sequence
  Description of Artificial Sequence: Synthetic oligonucleotide
  Target: ATXN1; (+) strand; PAM type: YTN; PAM sequence: CTA
gtttgctgaagtgcagagga

SEQ ID NO: 310524 - DNA, 20 bp, Artificial Sequence
  Description of Artificial Sequence: Synthetic oligonucleotide
  Target: ATXN1; (+) strand; PAM type: YTN; PAM sequence: TTT
gctgaagtgcagaggagggt

SEQ ID NO: 310525 - DNA, 20 bp, Artificial Sequence
  Description of Artificial Sequence: Synthetic oligonucleotide
  Target: ATXN1; (+) strand; PAM type: YTN; PAM sequence: TTG
ctgaagtgcagaggagggtc

SEQ ID NO: 310526 - DNA, 20 bp, Artificial Sequence
  Description of Artificial Sequence: Synthetic oligonucleotide
  Target: ATXN1; (+) strand; PAM type: YTN; PAM sequence: CTG
aagtgcagaggagggtcaaa

SEQ ID NO: 310527 - DNA, 20 bp, Artificial Sequence
  Description of Artificial Sequence: Synthetic oligonucleotide
  Target: ATXN1; (+) strand; PAM type: YTN; PAM sequence: TTA
ctttactcttgcatgagtat

SEQ ID NO: 310528 - DNA, 20 bp, Artificial Sequence
  Description of Artificial Sequence: Synthetic oligonucleotide
  Target: ATXN1; (+) strand; PAM type: YTN; PAM sequence: CTT
tactcttgcatgagtatgct

SEQ ID NO: 310529 - DNA, 20 bp, Artificial Sequence
  Description of Artificial Sequence: Synthetic oligonucleotide
  Target: ATXN1; (+) strand; PAM type: YTN; PAM sequence: TTT
actcttgcatgagtatgctt

SEQ ID NO: 310530 - DNA, 20 bp, Artificial Sequence
  Description of Artificial Sequence: Synthetic oligonucleotide
  Target: ATXN1; (+) strand; PAM type: YTN; PAM sequence: TTA
ctcttgcatgagtatgcttt

SEQ ID NO: 310531 - DNA, 20 bp, Artificial Sequence
  Description of Artificial Sequence: Synthetic oligonucleotide
  Target: ATXN1; (+) strand; PAM type: YTN; PAM sequence: CTC
ttgcatgagtatgctttctt

SEQ ID NO: 310532 - DNA, 20 bp, Artificial Sequence
  Description of Artificial Sequence: Synthetic oligonucleotide
  Target: ATXN1; (+) strand; PAM type: YTN; PAM sequence: CTT
gcatgagtatgctttcttat

SEQ ID NO: 310533 - DNA, 20 bp, Artificial Sequence
  Description of Artificial Sequence: Synthetic oligonucleotide
  Target: ATXN1; (+) strand; PAM type: YTN; PAM sequence: TTG
catgagtatgctttcttatt

SEQ ID NO: 310534 - DNA, 20 bp, Artificial Sequence
  Description of Artificial Sequence: Synthetic oligonucleotide
  Target: ATXN1; (+) strand; PAM type: YTN; PAM sequence: CTT
tcttatttcaaaagtatttg

SEQ ID NO: 310535 - DNA, 20 bp, Artificial Sequence
  Description of Artificial Sequence: Synthetic oligonucleotide
  Target: ATXN1; (+) strand; PAM type: YTN; PAM sequence: TTT
cttatttcaaaagtatttgt

SEQ ID NO: 310536 - DNA, 20 bp, Artificial Sequence
  Description of Artificial Sequence: Synthetic oligonucleotide
  Target: ATXN1; (+) strand; PAM type: YTN; PAM sequence: TTC
ttatttcaaaagtatttgtg

SEQ ID NO: 310537 - DNA, 20 bp, Artificial Sequence
  Description of Artificial Sequence: Synthetic oligonucleotide
  Target: ATXN1; (+) strand; PAM type: YTN; PAM sequence: CTT
atttcaaaagtatttgtgtt

SEQ ID NO: 310538 - DNA, 20 bp, Artificial Sequence
  Description of Artificial Sequence: Synthetic oligonucleotide
  Target: ATXN1; (+) strand; PAM type: YTN; PAM sequence: TTA
tttcaaaagtatttgtgttg

SEQ ID NO: 310539 - DNA, 20 bp, Artificial Sequence
  Description of Artificial Sequence: Synthetic oligonucleotide
  Target: ATXN1; (+) strand; PAM type: YTN; PAM sequence: TTT
caaaagtatttgtgttgctg

SEQ ID NO: 310540 - DNA, 20 bp, Artificial Sequence
  Description of Artificial Sequence: Synthetic oligonucleotide
  Target: ATXN1; (+) strand; PAM type: YTN; PAM sequence: TTC
aaaagtatttgtgttgctgc

SEQ ID NO: 310541 - DNA, 20 bp, Artificial Sequence
  Description of Artificial Sequence: Synthetic oligonucleotide
  Target: ATXN1; (+) strand; PAM type: YTN; PAM sequence: TTT
gtgttgctgcactagttagg

SEQ ID NO: 310542 - DNA, 20 bp, Artificial Sequence
  Description of Artificial Sequence: Synthetic oligonucleotide
  Target: ATXN1; (+) strand; PAM type: YTN; PAM sequence: TTG
tgttgctgcactagttagga

SEQ ID NO: 310543 - DNA, 20 bp, Artificial Sequence
  Description of Artificial Sequence: Synthetic oligonucleotide
  Target: ATXN1; (+) strand; PAM type: YTN; PAM sequence: TTG
ctgcactagttaggataata

SEQ ID NO: 310544 - DNA, 20 bp, Artificial Sequence
  Description of Artificial Sequence: Synthetic oligonucleotide
  Target: ATXN1; (+) strand; PAM type: YTN; PAM sequence: CTG
cactagttaggataatacag

SEQ ID NO: 310545 - DNA, 20 bp, Artificial Sequence
  Description of Artificial Sequence: Synthetic oligonucleotide
  Target: ATXN1; (+) strand; PAM type: YTN; PAM sequence: CTA
gttaggataatacagagagt

SEQ ID NO: 310546 - DNA, 20 bp, Artificial Sequence
  Description of Artificial Sequence: Synthetic oligonucleotide
  Target: ATXN1; (+) strand; PAM type: YTN; PAM sequence: TTA
ggataatacagagagtttac

SEQ ID NO: 310547 - DNA, 20 bp, Artificial Sequence
  Description of Artificial Sequence: Synthetic oligonucleotide
  Target: ATXN1; (+) strand; PAM type: YTN; PAM sequence: TTT
acataacttgtattccatca

SEQ ID NO: 310548 - DNA, 20 bp, Artificial Sequence
  Description of Artificial Sequence: Synthetic oligonucleotide
  Target: ATXN1; (+) strand; PAM type: YTN; PAM sequence: TTA
cataacttgtattccatcag

SEQ ID NO: 310549 - DNA, 20 bp, Artificial Sequence
  Description of Artificial Sequence: Synthetic oligonucleotide
  Target: ATXN1; (+) strand; PAM type: YTN; PAM sequence: CTT
gtattccatcagagggaaga

SEQ ID NO: 310550 - DNA, 20 bp, Artificial Sequence
  Description of Artificial Sequence: Synthetic oligonucleotide
  Target: ATXN1; (+) strand; PAM type: YTN; PAM sequence: TTG
tattccatcagagggaagaa

SEQ ID NO: 310551 - DNA, 20 bp, Artificial Sequence
  Description of Artificial Sequence: Synthetic oligonucleotide
  Target: ATXN1; (+) strand; PAM type: YTN; PAM sequence: TTC
catcagagggaagaaggcaa

SEQ ID NO: 310552 - DNA, 20 bp, Artificial Sequence
  Description of Artificial Sequence: Synthetic oligonucleotide
  Target: ATXN1; (+) strand; PAM type: YTN; PAM sequence: TTC
actgcaaaaacttacaaaat

SEQ ID NO: 310553 - DNA, 20 bp, Artificial Sequence
  Description of Artificial Sequence: Synthetic oligonucleotide
  Target: ATXN1; (+) strand; PAM type: YTN; PAM sequence: CTG
caaaaacttacaaaataata

SEQ ID NO: 310554 - DNA, 20 bp, Artificial Sequence
  Description of Artificial Sequence: Synthetic oligonucleotide
  Target: ATXN1; (+) strand; PAM type: YTN; PAM sequence: CTT
acaaaataatataccagaaa

SEQ ID NO: 310555 - DNA, 20 bp, Artificial Sequence
  Description of Artificial Sequence: Synthetic oligonucleotide
  Target: ATXN1; (+) strand; PAM type: YTN; PAM sequence: TTA
caaaataatataccagaaaa

SEQ ID NO: 310556 - DNA, 20 bp, Artificial Sequence
  Description of Artificial Sequence: Synthetic oligonucleotide
  Target: ATXN1; (+) strand; PAM type: YTN; PAM sequence: TTT
ataggacattttatacaata

SEQ ID NO: 310557 - DNA, 20 bp, Artificial Sequence
  Description of Artificial Sequence: Synthetic oligonucleotide
  Target: ATXN1; (+) strand; PAM type: YTN; PAM sequence: TTA
taggacattttatacaataa

SEQ ID NO: 310558 - DNA, 20 bp, Artificial Sequence
  Description of Artificial Sequence: Synthetic oligonucleotide
  Target: ATXN1; (+) strand; PAM type: YTN; PAM sequence: TTT
tatacaataatatacaccaa

SEQ ID NO: 310559 - DNA, 20 bp, Artificial Sequence
  Description of Artificial Sequence: Synthetic oligonucleotide
  Target: ATXN1; (+) strand; PAM type: YTN; PAM sequence: TTT
atacaataatatacaccaaa

SEQ ID NO: 310560 - DNA, 20 bp, Artificial Sequence
  Description of Artificial Sequence: Synthetic oligonucleotide
  Target: ATXN1; (+) strand; PAM type: YTN; PAM sequence: TTA
tacaataatatacaccaaaa

SEQ ID NO: 310561 - DNA, 20 bp, Artificial Sequence
  Description of Artificial Sequence: Synthetic oligonucleotide
  Target: ATXN1; (+) strand; PAM type: YTN; PAM sequence: CTC
aatatttttaaaacccagca

SEQ ID NO: 310562 - DNA, 20 bp, Artificial Sequence
  Description of Artificial Sequence: Synthetic oligonucleotide
  Target: ATXN1; (+) strand; PAM type: YTN; PAM sequence: TTT
ttaaaacccagcagagcaac

SEQ ID NO: 310563 - DNA, 20 bp, Artificial Sequence
  Description of Artificial Sequence: Synthetic oligonucleotide
  Target: ATXN1; (+) strand; PAM type: YTN; PAM sequence: TTT
taaaacccagcagagcaaca

SEQ ID NO: 310564 - DNA, 20 bp, Artificial Sequence
  Description of Artificial Sequence: Synthetic oligonucleotide
  Target: ATXN1; (+) strand; PAM type: YTN; PAM sequence: TTT
aaaacccagcagagcaacat

SEQ ID NO: 310565 - DNA, 20 bp, Artificial Sequence
  Description of Artificial Sequence: Synthetic oligonucleotide
  Target: ATXN1; (+) strand; PAM type: YTN; PAM sequence: TTA
aaacccagcagagcaacata

SEQ ID NO: 310566 - DNA, 20 bp, Artificial Sequence
  Description of Artificial Sequence: Synthetic oligonucleotide
  Target: ATXN1; (+) strand; PAM type: YTN; PAM sequence: CTA
ttaatattggaagattaaca

SEQ ID NO: 310567 - DNA, 20 bp, Artificial Sequence
  Description of Artificial Sequence: Synthetic oligonucleotide
  Target: ATXN1; (+) strand; PAM type: YTN; PAM sequence: TTA
atattggaagattaacaaga

SEQ ID NO: 310568 - DNA, 20 bp, Artificial Sequence
  Description of Artificial Sequence: Synthetic oligonucleotide
  Target: ATXN1; (+) strand; PAM type: YTN; PAM sequence: TTG
gaagattaacaagaaagacg

SEQ ID NO: 310569 - DNA, 20 bp, Artificial Sequence
  Description of Artificial Sequence: Synthetic oligonucleotide
  Target: ATXN1; (+) strand; PAM type: YTN; PAM sequence: TTA
acaagaaagacggcctaaac

SEQ ID NO: 310570 - DNA, 20 bp, Artificial Sequence
  Description of Artificial Sequence: Synthetic oligonucleotide
  Target: ATXN1; (+) strand; PAM type: YTN; PAM sequence: CTA
aacaaaactgaggtaatggt

SEQ ID NO: 310571 - DNA, 20 bp, Artificial Sequence
  Description of Artificial Sequence: Synthetic oligonucleotide
  Target: ATXN1; (+) strand; PAM type: YTN; PAM sequence: CTG
aggtaatggtcagtaagtac

SEQ ID NO: 310572 - DNA, 20 bp, Artificial Sequence
  Description of Artificial Sequence: Synthetic oligonucleotide
  Target: ATXN1; (+) strand; PAM type: YTN; PAM sequence: TTA
agggcacaagaaaataaagt

SEQ ID NO: 310573 - DNA, 20 bp, Artificial Sequence
  Description of Artificial Sequence: Synthetic oligonucleotide
  Target: ATXN1; (+) strand; PAM type: YTN; PAM sequence: TTT
gccatacacagtgacagaaa

SEQ ID NO: 310574 - DNA, 20 bp, Artificial Sequence
  Description of Artificial Sequence: Synthetic oligonucleotide
  Target: ATXN1; (+) strand; PAM type: YTN; PAM sequence: TTG
ccatacacagtgacagaaaa

SEQ ID NO: 310575 - DNA, 20 bp, Artificial Sequence
  Description of Artificial Sequence: Synthetic oligonucleotide
  Target: ATXN1; (+) strand; PAM type: YTN; PAM sequence: TTT
tctttgaacgttagaaggat

SEQ ID NO: 310576 - DNA, 20 bp, Artificial Sequence
  Description of Artificial Sequence: Synthetic oligonucleotide
  Target: ATXN1; (+) strand; PAM type: YTN; PAM sequence: TTT
ctttgaacgttagaaggata

SEQ ID NO: 310577 - DNA, 20 bp, Artificial Sequence
  Description of Artificial Sequence: Synthetic oligonucleotide
  Target: ATXN1; (+) strand; PAM type: YTN; PAM sequence: TTC
tttgaacgttagaaggatag

SEQ ID NO: 310578 - DNA, 20 bp, Artificial Sequence
  Description of Artificial Sequence: Synthetic oligonucleotide
  Target: ATXN1; (+) strand; PAM type: YTN; PAM sequence: CTT
tgaacgttagaaggatagat

SEQ ID NO: 310579 - DNA, 20 bp, Artificial Sequence
  Description of Artificial Sequence: Synthetic oligonucleotide
  Target: ATXN1; (+) strand; PAM type: YTN; PAM sequence: TTT
gaacgttagaaggatagatg

SEQ ID NO: 310580 - DNA, 20 bp, Artificial Sequence
  Description of Artificial Sequence: Synthetic oligonucleotide
  Target: ATXN1; (+) strand; PAM type: YTN; PAM sequence: TTG
aacgttagaaggatagatgc

SEQ ID NO: 310581 - DNA, 20 bp, Artificial Sequence
  Description of Artificial Sequence: Synthetic oligonucleotide
  Target: ATXN1; (+) strand; PAM type: YTN; PAM sequence: TTA
gaaggatagatgctataggt

SEQ ID NO: 310582 - DNA, 20 bp, Artificial Sequence
  Description of Artificial Sequence: Synthetic oligonucleotide
  Target: ATXN1; (+) strand; PAM type: YTN; PAM sequence: CTA
taggttagtagctacaataa

SEQ ID NO: 310583 - DNA, 20 bp, Artificial Sequence
  Description of Artificial Sequence: Synthetic oligonucleotide
  Target: ATXN1; (+) strand; PAM type: YTN; PAM sequence: TTA
gtagctacaataactgtcac

SEQ ID NO: 310584 - DNA, 20 bp, Artificial Sequence
  Description of Artificial Sequence: Synthetic oligonucleotide
  Target: ATXN1; (+) strand; PAM type: YTN; PAM sequence: CTA
caataactgtcacgaaaaac

SEQ ID NO: 310585 - DNA, 20 bp, Artificial Sequence
  Description of Artificial Sequence: Synthetic oligonucleotide
  Target: ATXN1; (+) strand; PAM type: YTN; PAM sequence: CTG
tcacgaaaaacttctgctac

SEQ ID NO: 310586 - DNA, 20 bp, Artificial Sequence
  Description of Artificial Sequence: Synthetic oligonucleotide
  Target: ATXN1; (+) strand; PAM type: YTN; PAM sequence: CTT
ctgctacctaactcattcaa

SEQ ID NO: 310587 - DNA, 20 bp, Artificial Sequence
  Description of Artificial Sequence: Synthetic oligonucleotide
  Target: ATXN1; (+) strand; PAM type: YTN; PAM sequence: TTC
tgctacctaactcattcaaa

SEQ ID NO: 310588 - DNA, 20 bp, Artificial Sequence
  Description of Artificial Sequence: Synthetic oligonucleotide
  Target: ATXN1; (+) strand; PAM type: YTN; PAM sequence: CTG
ctacctaactcattcaaaac

SEQ ID NO: 310589 - DNA, 20 bp, Artificial Sequence
  Description of Artificial Sequence: Synthetic oligonucleotide
  Target: ATXN1; (+) strand; PAM type: YTN; PAM sequence: CTA
cctaactcattcaaaacttg

SEQ ID NO: 310590 - DNA, 20 bp, Artificial Sequence
  Description of Artificial Sequence: Synthetic oligonucleotide
  Target: ATXN1; (+) strand; PAM type: YTN; PAM sequence: CTA
actcattcaaaacttgtcat

SEQ ID NO: 310591 - DNA, 20 bp, Artificial Sequence
  Description of Artificial Sequence: Synthetic oligonucleotide
  Target: ATXN1; (+) strand; PAM type: YTN; PAM sequence: CTC
attcaaaacttgtcatgtta

SEQ ID NO: 310592 - DNA, 20 bp, Artificial Sequence
  Description of Artificial Sequence: Synthetic oligonucleotide
  Target: ATXN1; (+) strand; PAM type: YTN; PAM sequence: TTC
aaaacttgtcatgttaaagg

SEQ ID NO: 310593 - DNA, 20 bp, Artificial Sequence
  Description of Artificial Sequence: Synthetic oligonucleotide
  Target: ATXN1; (+) strand; PAM type: YTN; PAM sequence: CTT
gtcatgttaaagggcaccta

SEQ ID NO: 310594 - DNA, 20 bp, Artificial Sequence
  Description of Artificial Sequence: Synthetic oligonucleotide
  Target: ATXN1; (+) strand; PAM type: YTN; PAM sequence: TTG
tcatgttaaagggcacctaa

SEQ ID NO: 310595 - DNA, 20 bp, Artificial Sequence
  Description of Artificial Sequence: Synthetic oligonucleotide
  Target: ATXN1; (+) strand; PAM type: YTN; PAM sequence: TTA
aagggcacctaagtgtaaaa

SEQ ID NO: 310596 - DNA, 20 bp, Artificial Sequence
  Description of Artificial Sequence: Synthetic oligonucleotide
  Target: ATXN1; (+) strand; PAM type: YTN; PAM sequence: CTA
agtgtaaaaaaaaaaaaaaa

SEQ ID NO: 310597 - DNA, 20 bp, Artificial Sequence
  Description of Artificial Sequence: Synthetic oligonucleotide
  Target: ATXN1; (+) strand; PAM type: YTN; PAM sequence: TTC
ctcttagcccaaatcaaaac

SEQ ID NO: 310598 - DNA, 20 bp, Artificial Sequence
  Description of Artificial Sequence: Synthetic oligonucleotide
  Target: ATXN1; (+) strand; PAM type: YTN; PAM sequence: CTC
ttagcccaaatcaaaacatc

SEQ ID NO: 310599 - DNA, 20 bp, Artificial Sequence
  Description of Artificial Sequence: Synthetic oligonucleotide
  Target: ATXN1; (+) strand; PAM type: YTN; PAM sequence: CTT
agcccaaatcaaaacatcac

SEQ ID NO: 310600 - DNA, 20 bp, Artificial Sequence
  Description of Artificial Sequence: Synthetic oligonucleotide
  Target: ATXN1; (+) strand; PAM type: YTN; PAM sequence: TTA
gcccaaatcaaaacatcaca

SEQ ID NO: 310601 - DNA, 20 bp, Artificial Sequence
  Description of Artificial Sequence: Synthetic oligonucleotide
  Target: ATXN1; (+) strand; PAM type: YTN; PAM sequence: CTC
tgccctcttgagtctcaaat

SEQ ID NO: 310602 - DNA, 20 bp, Artificial Sequence
  Description of Artificial Sequence: Synthetic oligonucleotide
  Target: ATXN1; (+) strand; PAM type: YTN; PAM sequence: CTG
ccctcttgagtctcaaattc

SEQ ID NO: 310603 - DNA, 20 bp, Artificial Sequence
  Description of Artificial Sequence: Synthetic oligonucleotide
  Target: ATXN1; (+) strand; PAM type: YTN; PAM sequence: CTC
ttgagtctcaaattctgagt

SEQ ID NO: 310604 - DNA, 20 bp, Artificial Sequence
  Description of Artificial Sequence: Synthetic oligonucleotide
  Target: ATXN1; (+) strand; PAM type: YTN; PAM sequence: CTT
gagtctcaaattctgagtac

SEQ ID NO: 310605 - DNA, 20 bp, Artificial Sequence
  Description of Artificial Sequence: Synthetic oligonucleotide
  Target: ATXN1; (+) strand; PAM type: YTN; PAM sequence: TTG
agtctcaaattctgagtaca

SEQ ID NO: 310606 - DNA, 20 bp, Artificial Sequence
  Description of Artificial Sequence: Synthetic oligonucleotide
  Target: ATXN1; (+) strand; PAM type: YTN; PAM sequence: CTC
aaattctgagtacactacca

SEQ ID NO: 310607 - DNA, 20 bp, Artificial Sequence
  Description of Artificial Sequence: Synthetic oligonucleotide
  Target: ATXN1; (+) strand; PAM type: YTN; PAM sequence: TTC
tgagtacactaccatgaatt

SEQ ID NO: 310608 - DNA, 20 bp, Artificial Sequence
  Description of Artificial Sequence: Synthetic oligonucleotide
  Target: ATXN1; (+) strand; PAM type: YTN; PAM sequence: CTG
agtacactaccatgaatttt

SEQ ID NO: 310609 - DNA, 20 bp, Artificial Sequence
  Description of Artificial Sequence: Synthetic oligonucleotide
  Target: ATXN1; (+) strand; PAM type: YTN; PAM sequence: CTA
ccatgaattttctggaaagt

SEQ ID NO: 310610 - DNA, 20 bp, Artificial Sequence
  Description of Artificial Sequence: Synthetic oligonucleotide
  Target: ATXN1; (+) strand; PAM type: YTN; PAM sequence: TTT
tctggaaagtaattttcagg

SEQ ID NO: 310611 - DNA, 20 bp, Artificial Sequence
  Description of Artificial Sequence: Synthetic oligonucleotide
  Target: ATXN1; (+) strand; PAM type: YTN; PAM sequence: TTT
ctggaaagtaattttcaggt

SEQ ID NO: 310612 - DNA, 20 bp, Artificial Sequence
  Description of Artificial Sequence: Synthetic oligonucleotide
  Target: ATXN1; (+) strand; PAM type: YTN; PAM sequence: TTC
tggaaagtaattttcaggta

SEQ ID NO: 310613 - DNA, 20 bp, Artificial Sequence
  Description of Artificial Sequence: Synthetic oligonucleotide
  Target: ATXN1; (+) strand; PAM type: YTN; PAM sequence: CTG
gaaagtaattttcaggtagg

SEQ ID NO: 310614 - DNA, 20 bp, Artificial Sequence
  Description of Artificial Sequence: Synthetic oligonucleotide
  Target: ATXN1; (+) strand; PAM type: YTN; PAM sequence: TTT
tcaggtaggatacaattttt

SEQ ID NO: 310615 - DNA, 20 bp, Artificial Sequence
  Description of Artificial Sequence: Synthetic oligonucleotide
  Target: ATXN1; (+) strand; PAM type: YTN; PAM sequence: TTT
caggtaggatacaatttttg

SEQ ID NO: 310616 - DNA, 20 bp, Artificial Sequence
  Description of Artificial Sequence: Synthetic oligonucleotide
  Target: ATXN1; (+) strand; PAM type: YTN; PAM sequence: TTC
aggtaggatacaatttttgc

SEQ ID NO: 310617 - DNA, 20 bp, Artificial Sequence
  Description of Artificial Sequence: Synthetic oligonucleotide
  Target: ATXN1; (+) strand; PAM type: YTN; PAM sequence: TTT
ttgcttacattgtggcaatt

SEQ ID NO: 310618 - DNA, 20 bp, Artificial Sequence
  Description of Artificial Sequence: Synthetic oligonucleotide
  Target: ATXN1; (+) strand; PAM type: YTN; PAM sequence: TTT
tgcttacattgtggcaatta

SEQ ID NO: 310619 - DNA, 20 bp, Artificial Sequence
  Description of Artificial Sequence: Synthetic oligonucleotide
  Target: ATXN1; (+) strand; PAM type: YTN; PAM sequence: TTT
gcttacattgtggcaattat

SEQ ID NO: 310620 - DNA, 20 bp, Artificial Sequence
  Description of Artificial Sequence: Synthetic oligonucleotide
  Target: ATXN1; (+) strand; PAM type: YTN; PAM sequence: TTG
cttacattgtggcaattatc

SEQ ID NO: 310621 - DNA, 20 bp, Artificial Sequence
  Description of Artificial Sequence: Synthetic oligonucleotide
  Target: ATXN1; (+) strand; PAM type: YTN; PAM sequence: CTT
acattgtggcaattatcatt

SEQ ID NO: 310622 - DNA, 20 bp, Artificial Sequence
  Description of Artificial Sequence: Synthetic oligonucleotide
  Target: ATXN1; (+) strand; PAM type: YTN; PAM sequence: TTA
cattgtggcaattatcatta

SEQ ID NO: 310623 - DNA, 20 bp, Artificial Sequence
  Description of Artificial Sequence: Synthetic oligonucleotide
  Target: ATXN1; (+) strand; PAM type: YTN; PAM sequence: TTG
tggcaattatcattacattt

SEQ ID NO: 310624 - DNA, 20 bp, Artificial Sequence
  Description of Artificial Sequence: Synthetic oligonucleotide
  Target: ATXN1; (+) strand; PAM type: YTN; PAM sequence: TTA
tcattacattttcattactc

SEQ ID NO: 310625 - DNA, 20 bp, Artificial Sequence
  Description of Artificial Sequence: Synthetic oligonucleotide
  Target: ATXN1; (+) strand; PAM type: YTN; PAM sequence: TTA
cattttcattactccacaaa

SEQ ID NO: 310626 - DNA, 20 bp, Artificial Sequence
  Description of Artificial Sequence: Synthetic oligonucleotide
  Target: ATXN1; (+) strand; PAM type: YTN; PAM sequence: TTT
tcattactccacaaatggga

SEQ ID NO: 310627 - DNA, 20 bp, Artificial Sequence
  Description of Artificial Sequence: Synthetic oligonucleotide
  Target: ATXN1; (+) strand; PAM type: YTN; PAM sequence: TTT
cattactccacaaatgggat

SEQ ID NO: 310628 - DNA, 20 bp, Artificial Sequence
  Description of Artificial Sequence: Synthetic oligonucleotide
  Target: ATXN1; (+) strand; PAM type: YTN; PAM sequence: TTC
attactccacaaatgggatg

SEQ ID NO: 310629 - DNA, 20 bp, Artificial Sequence
  Description of Artificial Sequence: Synthetic oligonucleotide
  Target: ATXN1; (+) strand; PAM type: YTN; PAM sequence: TTA
ctccacaaatgggatgcatt

SEQ ID NO: 310630 - DNA, 20 bp, Artificial Sequence
  Description of Artificial Sequence: Synthetic oligonucleotide
  Target: ATXN1; (+) strand; PAM type: YTN; PAM sequence: CTC
cacaaatgggatgcattaaa

SEQ ID NO: 310631 - DNA, 20 bp, Artificial Sequence
  Description of Artificial Sequence: Synthetic oligonucleotide
  Target: ATXN1; (+) strand; PAM type: YTN; PAM sequence: TTA
aaagttacagaaaaatcaat

SEQ ID NO: 310632 - DNA, 20 bp, Artificial Sequence
  Description of Artificial Sequence: Synthetic oligonucleotide
  Target: ATXN1; (+) strand; PAM type: YTN; PAM sequence: TTA
cagaaaaatcaatgaaacat

SEQ ID NO: 310633 - DNA, 20 bp, Artificial Sequence
  Description of Artificial Sequence: Synthetic oligonucleotide
  Target: ATXN1; (+) strand; PAM type: YTN; PAM sequence: TTT
ctgctaacatgaaatatgtc

SEQ ID NO: 310634 - DNA, 20 bp, Artificial Sequence
  Description of Artificial Sequence: Synthetic oligonucleotide
  Target: ATXN1; (+) strand; PAM type: YTN; PAM sequence: TTC
tgctaacatgaaatatgtca

SEQ ID NO: 310635 - DNA, 20 bp, Artificial Sequence
  Description of Artificial Sequence: Synthetic oligonucleotide
  Target: ATXN1; (+) strand; PAM type: YTN; PAM sequence: CTG
ctaacatgaaatatgtcaaa

SEQ ID NO: 310636 - DNA, 20 bp, Artificial Sequence
  Description of Artificial Sequence: Synthetic oligonucleotide
  Target: ATXN1; (+) strand; PAM type: YTN; PAM sequence: CTA
acatgaaatatgtcaaacaa

SEQ ID NO: 310637 - DNA, 20 bp, Artificial Sequence
  Description of Artificial Sequence: Synthetic oligonucleotide
  Target: ATXN1; (+) strand; PAM type: YTN; PAM sequence: CTT
gttgcttttttgtccataat

SEQ ID NO: 310638 - DNA, 20 bp, Artificial Sequence
  Description of Artificial Sequence: Synthetic oligonucleotide
  Target: ATXN1; (+) strand; PAM type: YTN; PAM sequence: TTG
ttgcttttttgtccataatt

SEQ ID NO: 310639 - DNA, 20 bp, Artificial Sequence
  Description of Artificial Sequence: Synthetic oligonucleotide
  Target: ATXN1; (+) strand; PAM type: YTN; PAM sequence: TTG
cttttttgtccataattgtt

SEQ ID NO: 310640 - DNA, 20 bp, Artificial Sequence
  Description of Artificial Sequence: Synthetic oligonucleotide
  Target: ATXN1; (+) strand; PAM type: YTN; PAM sequence: CTT
ttttgtccataattgttctc

SEQ ID NO: 310641 - DNA, 20 bp, Artificial Sequence
  Description of Artificial Sequence: Synthetic oligonucleotide
  Target: ATXN1; (+) strand; PAM type: YTN; PAM sequence: TTT
tttgtccataattgttctct

SEQ ID NO: 310642 - DNA, 20 bp, Artificial Sequence
  Description of Artificial Sequence: Synthetic oligonucleotide
  Target: ATXN1; (+) strand; PAM type: YTN; PAM sequence: TTT
ttgtccataattgttctctc

SEQ ID NO: 310643 - DNA, 20 bp, Artificial Sequence
  Description of Artificial Sequence: Synthetic oligonucleotide
  Target: ATXN1; (+) strand; PAM type: YTN; PAM sequence: TTT
tgtccataattgttctctct

SEQ ID NO: 310644 - DNA, 20 bp, Artificial Sequence
  Description of Artificial Sequence: Synthetic oligonucleotide
  Target: ATXN1; (+) strand; PAM type: YTN; PAM sequence: TTT
gtccataattgttctctcta

SEQ ID NO: 310645 - DNA, 20 bp, Artificial Sequence
  Description of Artificial Sequence: Synthetic oligonucleotide
  Target: ATXN1; (+) strand; PAM type: YTN; PAM sequence: TTG
tccataattgttctctctaa

SEQ ID NO: 310646 - DNA, 20 bp, Artificial Sequence
  Description of Artificial Sequence: Synthetic oligonucleotide
  Target: ATXN1; (+) strand; PAM type: YTN; PAM sequence: TTG
ttctctctaaacgtgttttg

SEQ ID NO: 310647 - DNA, 20 bp, Artificial Sequence
  Description of Artificial Sequence: Synthetic oligonucleotide
  Target: ATXN1; (+) strand; PAM type: YTN; PAM sequence: TTC
tctctaaacgtgttttggta

SEQ ID NO: 310648 - DNA, 20 bp, Artificial Sequence
  Description of Artificial Sequence: Synthetic oligonucleotide
  Target: ATXN1; (+) strand; PAM type: YTN; PAM sequence: CTC
tctaaacgtgttttggtaca

SEQ ID NO: 310649 - DNA, 20 bp, Artificial Sequence
  Description of Artificial Sequence: Synthetic oligonucleotide
  Target: ATXN1; (+) strand; PAM type: YTN; PAM sequence: CTC
taaacgtgttttggtacatt

SEQ ID NO: 310650 - DNA, 20 bp, Artificial Sequence
  Description of Artificial Sequence: Synthetic oligonucleotide
  Target: ATXN1; (+) strand; PAM type: YTN; PAM sequence: CTA
aacgtgttttggtacatttg

SEQ ID NO: 310651 - DNA, 20 bp, Artificial Sequence
  Description of Artificial Sequence: Synthetic oligonucleotide
  Target: ATXN1; (+) strand; PAM type: YTN; PAM sequence: TTT
tggtacatttgggatggtag

SEQ ID NO: 310652 - DNA, 20 bp, Artificial Sequence
  Description of Artificial Sequence: Synthetic oligonucleotide
  Target: ATXN1; (+) strand; PAM type: YTN; PAM sequence: TTT
ggtacatttgggatggtagt

SEQ ID NO: 310653 - DNA, 20 bp, Artificial Sequence
  Description of Artificial Sequence: Synthetic oligonucleotide
  Target: ATXN1; (+) strand; PAM type: YTN; PAM sequence: TTG
gtacatttgggatggtagta

SEQ ID NO: 310654 - DNA, 20 bp, Artificial Sequence
  Description of Artificial Sequence: Synthetic oligonucleotide
  Target: ATXN1; (+) strand; PAM type: YTN; PAM sequence: TTT
gggatggtagtaatgcgtaa

SEQ ID NO: 310655 - DNA, 20 bp, Artificial Sequence
  Description of Artificial Sequence: Synthetic oligonucleotide
  Target: ATXN1; (+) strand; PAM type: YTN; PAM sequence: TTG
ggatggtagtaatgcgtaat

SEQ ID NO: 310656 - DNA, 20 bp, Artificial Sequence
  Description of Artificial Sequence: Synthetic oligonucleotide
  Target: ATXN1; (+) strand; PAM type: YTN; PAM sequence: TTT
atagtacattagcctgaaag

SEQ ID NO: 310657 - DNA, 20 bp, Artificial Sequence
  Description of Artificial Sequence: Synthetic oligonucleotide
  Target: ATXN1; (+) strand; PAM type: YTN; PAM sequence: TTA
tagtacattagcctgaaagt

SEQ ID NO: 310658 - DNA, 20 bp, Artificial Sequence
  Description of Artificial Sequence: Synthetic oligonucleotide
  Target: ATXN1; (+) strand; PAM type: YTN; PAM sequence: TTA
gcctgaaagttcaaattatg

SEQ ID NO: 310659 - DNA, 20 bp, Artificial Sequence
  Description of Artificial Sequence: Synthetic oligonucleotide
  Target: ATXN1; (+) strand; PAM type: YTN; PAM sequence: CTG
aaagttcaaattatgagcgt

SEQ ID NO: 310660 - DNA, 20 bp, Artificial Sequence
  Description of Artificial Sequence: Synthetic oligonucleotide
  Target: ATXN1; (+) strand; PAM type: YTN; PAM sequence: TTC
aaattatgagcgttataaaa

SEQ ID NO: 310661 - DNA, 20 bp, Artificial Sequence
  Description of Artificial Sequence: Synthetic oligonucleotide
  Target: ATXN1; (+) strand; PAM type: YTN; PAM sequence: TTA
tgagcgttataaaatatatt

SEQ ID NO: 310662 - DNA, 20 bp, Artificial Sequence
  Description of Artificial Sequence: Synthetic oligonucleotide
  Target: ATXN1; (+) strand; PAM type: YTN; PAM sequence: TTA
taaaatatattactacacta

SEQ ID NO: 310663 - DNA, 20 bp, Artificial Sequence
  Description of Artificial Sequence: Synthetic oligonucleotide
  Target: ATXN1; (+) strand; PAM type: YTN; PAM sequence: TTA
ctacactaataaagacaaat

SEQ ID NO: 310664 - DNA, 20 bp, Artificial Sequence
  Description of Artificial Sequence: Synthetic oligonucleotide
  Target: ATXN1; (+) strand; PAM type: YTN; PAM sequence: CTA
cactaataaagacaaatatc

SEQ ID NO: 310665 - DNA, 20 bp, Artificial Sequence
  Description of Artificial Sequence: Synthetic oligonucleotide
  Target: ATXN1; (+) strand; PAM type: YTN; PAM sequence: CTA
ataaagacaaatatccataa

SEQ ID NO: 310666 - DNA, 20 bp, Artificial Sequence
  Description of Artificial Sequence: Synthetic oligonucleotide
  Target: ATXN1; (+) strand; PAM type: YTN; PAM sequence: TTA
taaaagaataaaataaaaaa

SEQ ID NO: 310667 - DNA, 20 bp, Artificial Sequence
  Description of Artificial Sequence: Synthetic oligonucleotide
  Target: ATXN1; (+) strand; PAM type: YTN; PAM sequence: CTT
tccataagatttgtctaaaa

SEQ ID NO: 310668 - DNA, 20 bp, Artificial Sequence
  Description of Artificial Sequence: Synthetic oligonucleotide
  Target: ATXN1; (+) strand; PAM type: YTN; PAM sequence: TTT
ccataagatttgtctaaaac

SEQ ID NO: 310669 - DNA, 20 bp, Artificial Sequence
  Description of Artificial Sequence: Synthetic oligonucleotide
  Target: ATXN1; (+) strand; PAM type: YTN; PAM sequence: TTC
cataagatttgtctaaaacc

SEQ ID NO: 310670 - DNA, 20 bp, Artificial Sequence
  Description of Artificial Sequence: Synthetic oligonucleotide
  Target: ATXN1; (+) strand; PAM type: YTN; PAM sequence: TTT
gtctaaaaccattcttttta

SEQ ID NO: 310671 - DNA, 20 bp, Artificial Sequence
  Description of Artificial Sequence: Synthetic oligonucleotide
  Target: ATXN1; (+) strand; PAM type: YTN; PAM sequence: TTG
tctaaaaccattctttttat

SEQ ID NO: 310672 - DNA, 20 bp, Artificial Sequence
  Description of Artificial Sequence: Synthetic oligonucleotide
  Target: ATXN1; (+) strand; PAM type: YTN; PAM sequence: CTA
aaaccattctttttattact

SEQ ID NO: 310673 - DNA, 20 bp, Artificial Sequence
  Description of Artificial Sequence: Synthetic oligonucleotide
  Target: ATXN1; (+) strand; PAM type: YTN; PAM sequence: TTC
tttttattacttctgtaatt

SEQ ID NO: 310674 - DNA, 20 bp, Artificial Sequence
  Description of Artificial Sequence: Synthetic oligonucleotide
  Target: ATXN1; (+) strand; PAM type: YTN; PAM sequence: CTT
tttattacttctgtaatttt

SEQ ID NO: 310675 - DNA, 20 bp, Artificial Sequence
  Description of Artificial Sequence: Synthetic oligonucleotide
  Target: ATXN1; (+) strand; PAM type: YTN; PAM sequence: TTT
ttattacttctgtaatttta

SEQ ID NO: 310676 - DNA, 20 bp, Artificial Sequence
  Description of Artificial Sequence: Synthetic oligonucleotide
  Target: ATXN1; (+) strand; PAM type: YTN; PAM sequence: TTT
tattacttctgtaattttaa

SEQ ID NO: 310677 - DNA, 20 bp, Artificial Sequence
  Description of Artificial Sequence: Synthetic oligonucleotide
  Target: ATXN1; (+) strand; PAM type: YTN; PAM sequence: TTT
attacttctgtaattttaag

SEQ ID NO: 310678 - DNA, 20 bp, Artificial Sequence
  Description of Artificial Sequence: Synthetic oligonucleotide
  Target: ATXN1; (+) strand; PAM type: YTN; PAM sequence: TTA
ttacttctgtaattttaagc

SEQ ID NO: 310679 - DNA, 20 bp, Artificial Sequence
  Description of Artificial Sequence: Synthetic oligonucleotide
  Target: ATXN1; (+) strand; PAM type: YTN; PAM sequence: TTA
cttctgtaattttaagcatt

SEQ ID NO: 310680 - DNA, 20 bp, Artificial Sequence
  Description of Artificial Sequence: Synthetic oligonucleotide
  Target: ATXN1; (+) strand; PAM type: YTN; PAM sequence: CTT
ctgtaattttaagcatttat

SEQ ID NO: 310681 - DNA, 20 bp, Artificial Sequence
  Description of Artificial Sequence: Synthetic oligonucleotide
  Target: ATXN1; (+) strand; PAM type: YTN; PAM sequence: TTC
tgtaattttaagcatttata

SEQ ID NO: 310682 - DNA, 20 bp, Artificial Sequence
  Description of Artificial Sequence: Synthetic oligonucleotide
  Target: ATXN1; (+) strand; PAM type: YTN; PAM sequence: CTG
taattttaagcatttatata

SEQ ID NO: 310683 - DNA, 20 bp, Artificial Sequence
  Description of Artificial Sequence: Synthetic oligonucleotide
  Target: ATXN1; (+) strand; PAM type: YTN; PAM sequence: TTT
taagcatttatatattttta

SEQ ID NO: 310684 - DNA, 20 bp, Artificial Sequence
  Description of Artificial Sequence: Synthetic oligonucleotide
  Target: ATXN1; (+) strand; PAM type: YTN; PAM sequence: TTT
aagcatttatatatttttaa

SEQ ID NO: 310685 - DNA, 20 bp, Artificial Sequence
  Description of Artificial Sequence: Synthetic oligonucleotide
  Target: ATXN1; (+) strand; PAM type: YTN; PAM sequence: TTA
agcatttatatatttttaaa

SEQ ID NO: 310686 - DNA, 20 bp, Artificial Sequence
  Description of Artificial Sequence: Synthetic oligonucleotide
  Target: ATXN1; (+) strand; PAM type: YTN; PAM sequence: TTT
atatatttttaaaaatctca

SEQ ID NO: 310687 - DNA, 20 bp, Artificial Sequence
  Description of Artificial Sequence: Synthetic oligonucleotide
  Target: ATXN1; (+) strand; PAM type: YTN; PAM sequence: TTA
tatatttttaaaaatctcaa

SEQ ID NO: 310688 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatctcaatgtaatt

SEQ ID NO: 310689 - DNA, 20 bp, Artificial Sequence
  Description of Artificial Sequence: Synthetic oligonucleotide
  Target: ATXN1; (+) strand; PAM type: YTN; PAM sequence: TTT
taaaaatctcaatgtaatta

SEQ ID NO: 310690 - DNA, 20 bp, Artificial Sequence
  Description of Artificial Sequence: Synthetic oligonucleotide
  Target: ATXN1; (+) strand; PAM type: YTN; PAM sequence: TTT
aaaaatctcaatgtaattac

SEQ ID NO: 310691 - DNA, 20 bp, Artificial Sequence
  Description of Artificial Sequence: Synthetic oligonucleotide
  Target: ATXN1; (+) strand; PAM type: YTN; PAM sequence: TTA
aaaatctcaatgtaattacc

SEQ ID NO: 310692 - DNA, 20 bp, Artificial Sequence
  Description of Artificial Sequence: Synthetic oligonucleotide
  Target: ATXN1; (+) strand; PAM type: YTN; PAM sequence: CTC
aatgtaattaccgttctttc

SEQ ID NO: 310693 - DNA, 20 bp, Artificial Sequence
  Description of Artificial Sequence: Synthetic oligonucleotide
  Target: ATXN1; (+) strand; PAM type: YTN; PAM sequence: TTA
ccgttctttcagccaacatt

SEQ ID NO: 310694 - DNA, 20 bp, Artificial Sequence
  Description of Artificial Sequence: Synthetic oligonucleotide
  Target: ATXN1; (+) strand; PAM type: YTN; PAM sequence: TTC
tttcagccaacatttaaaaa

SEQ ID NO: 310695 - DNA, 20 bp, Artificial Sequence
  Description of Artificial Sequence: Synthetic oligonucleotide
  Target: ATXN1; (+) strand; PAM type: YTN; PAM sequence: CTT
tcagccaacatttaaaaaat

SEQ ID NO: 310696 - DNA, 20 bp, Artificial Sequence
  Description of Artificial Sequence: Synthetic oligonucleotide
  Target: ATXN1; (+) strand; PAM type: YTN; PAM sequence: TTT
cagccaacatttaaaaaatt

SEQ ID NO: 310697 - DNA, 20 bp, Artificial Sequence
  Description of Artificial Sequence: Synthetic oligonucleotide
  Target: ATXN1; (+) strand; PAM type: YTN; PAM sequence: TTC
agccaacatttaaaaaattc

SEQ ID NO: 310698 - DNA, 20 bp, Artificial Sequence
  Description of Artificial Sequence: Synthetic oligonucleotide
  Target: ATXN1; (+) strand; PAM type: YTN; PAM sequence: TTT
aaaaaattctgtaaaactga

SEQ ID NO: 310699 - DNA, 20 bp, Artificial Sequence
  Description of Artificial Sequence: Synthetic oligonucleotide
  Target: ATXN1; (+) strand; PAM type: YTN; PAM sequence: TTA
aaaaattctgtaaaactgac

SEQ ID NO: 310700 - DNA, 20 bp, Artificial Sequence
  Description of Artificial Sequence: Synthetic oligonucleotide
  Target: ATXN1; (+) strand; PAM type: YTN; PAM sequence: TTC
tgtaaaactgacactgtata

SEQ ID NO: 310701 - DNA, 20 bp, Artificial Sequence
  Description of Artificial Sequence: Synthetic oligonucleotide
  Target: ATXN1; (+) strand; PAM type: YTN; PAM sequence: CTG
taaaactgacactgtatatc

SEQ ID NO: 310702 - DNA, 20 bp, Artificial Sequence
  Description of Artificial Sequence: Synthetic oligonucleotide
  Target: ATXN1; (+) strand; PAM type: YTN; PAM sequence: CTG
acactgtatatcacttctta

SEQ ID NO: 310703 - DNA, 20 bp, Artificial Sequence
  Description of Artificial Sequence: Synthetic oligonucleotide
  Target: ATXN1; (+) strand; PAM type: YTN; PAM sequence: CTG
tatatcacttcttaaaaaaa

SEQ ID NO: 310704 - DNA, 20 bp, Artificial Sequence
  Description of Artificial Sequence: Synthetic oligonucleotide
  Target: ATXN1; (+) strand; PAM type: YTN; PAM sequence: CTT
cttaaaaaaattttgaatga

SEQ ID NO: 310705 - DNA, 20 bp, Artificial Sequence
  Description of Artificial Sequence: Synthetic oligonucleotide
  Target: ATXN1; (+) strand; PAM type: YTN; PAM sequence: TTC
ttaaaaaaattttgaatgag

SEQ ID NO: 310706 - DNA, 20 bp, Artificial Sequence
  Description of Artificial Sequence: Synthetic oligonucleotide
  Target: ATXN1; (+) strand; PAM type: YTN; PAM sequence: CTT
aaaaaaattttgaatgagta

SEQ ID NO: 310707 - DNA, 20 bp, Artificial Sequence
  Description of Artificial Sequence: Synthetic oligonucleotide
  Target: ATXN1; (+) strand; PAM type: YTN; PAM sequence: TTA
aaaaaattttgaatgagtac

SEQ ID NO: 310708 - DNA, 20 bp, Artificial Sequence
  Description of Artificial Sequence: Synthetic oligonucleotide
  Target: ATXN1; (+) strand; PAM type: YTN; PAM sequence: TTT
tgaatgagtacatttatttt

SEQ ID NO: 310709 - DNA, 20 bp, Artificial Sequence
  Description of Artificial Sequence: Synthetic oligonucleotide
  Target: ATXN1; (+) strand; PAM type: YTN; PAM sequence: TTT
gaatgagtacatttatttta

SEQ ID NO: 310710 - DNA, 20 bp, Artificial Sequence
  Description of Artificial Sequence: Synthetic oligonucleotide
  Target: ATXN1; (+) strand; PAM type: YTN; PAM sequence: TTG
aatgagtacatttattttat

SEQ ID NO: 310711 - DNA, 20 bp, Artificial Sequence
  Description of Artificial Sequence: Synthetic oligonucleotide
  Target: ATXN1; (+) strand; PAM type: YTN; PAM sequence: TTT
attttattaaactaaattac

SEQ ID NO: 310712 - DNA, 20 bp, Artificial Sequence
  Description of Artificial Sequence: Synthetic oligonucleotide
  Target: ATXN1; (+) strand; PAM type: YTN; PAM sequence: TTA
ttttattaaactaaattaca

SEQ ID NO: 310713 - DNA, 20 bp, Artificial Sequence
  Description of Artificial Sequence: Synthetic oligonucleotide
  Target: ATXN1; (+) strand; PAM type: YTN; PAM sequence: TTT
tattaaactaaattacatga

SEQ ID NO: 310714 - DNA, 20 bp, Artificial Sequence
  Description of Artificial Sequence: Synthetic oligonucleotide
  Target: ATXN1; (+) strand; PAM type: YTN; PAM sequence: TTT
attaaactaaattacatgaa

SEQ ID NO: 310715 - DNA, 20 bp, Artificial Sequence
  Description of Artificial Sequence: Synthetic oligonucleotide
  Target: ATXN1; (+) strand; PAM type: YTN; PAM sequence: TTA
ttaaactaaattacatgaaa

SEQ ID NO: 310716 - DNA, 20 bp, Artificial Sequence
  Description of Artificial Sequence: Synthetic oligonucleotide
  Target: ATXN1; (+) strand; PAM type: YTN; PAM sequence: TTA
aactaaattacatgaaaata

SEQ ID NO: 310717 - DNA, 20 bp, Artificial Sequence
  Description of Artificial Sequence: Synthetic oligonucleotide
  Target: ATXN1; (+) strand; PAM type: YTN; PAM sequence: CTA
aattacatgaaaataaaatg

SEQ ID NO: 310718 - DNA, 20 bp, Artificial Sequence
  Description of Artificial Sequence: Synthetic oligonucleotide
  Target: ATXN1; (+) strand; PAM type: YTN; PAM sequence: TTA
catgaaaataaaatgtgaac

SEQ ID NO: 310719 - DNA, 20 bp, Artificial Sequence
  Description of Artificial Sequence: Synthetic oligonucleotide
  Target: ATXN1; (+) strand; PAM type: YTN; PAM sequence: TTG
atgacttaaaattcttatct

SEQ ID NO: 310720 - DNA, 20 bp, Artificial Sequence
  Description of Artificial Sequence: Synthetic oligonucleotide
  Target: ATXN1; (+) strand; PAM type: YTN; PAM sequence: CTT
aaaattcttatcttagaaaa

SEQ ID NO: 310721 - DNA, 20 bp, Artificial Sequence
  Description of Artificial Sequence: Synthetic oligonucleotide
  Target: ATXN1; (+) strand; PAM type: YTN; PAM sequence: TTA
aaattcttatcttagaaaag

SEQ ID NO: 310722 - DNA, 20 bp, Artificial Sequence
  Description of Artificial Sequence: Synthetic oligonucleotide
  Target: ATXN1; (+) strand; PAM type: YTN; PAM sequence: TTC
ttatcttagaaaaggaagtt

SEQ ID NO: 310723 - DNA, 20 bp, Artificial Sequence
  Description of Artificial Sequence: Synthetic oligonucleotide
  Target: ATXN1; (+) strand; PAM type: YTN; PAM sequence: CTT
atcttagaaaaggaagttct

SEQ ID NO: 310724 - DNA, 20 bp, Artificial Sequence
  Description of Artificial Sequence: Synthetic oligonucleotide
  Target: ATXN1; (+) strand; PAM type: YTN; PAM sequence: TTA
tcttagaaaaggaagttcta

SEQ ID NO: 310725 - DNA, 20 bp, Artificial Sequence
  Description of Artificial Sequence: Synthetic oligonucleotide
  Target: ATXN1; (+) strand; PAM type: YTN; PAM sequence: CTT
agaaaaggaagttctatatg

SEQ ID NO: 310726 - DNA, 20 bp, Artificial Sequence
  Description of Artificial Sequence: Synthetic oligonucleotide
  Target: ATXN1; (+) strand; PAM type: YTN; PAM sequence: TTA
gaaaaggaagttctatatgt

SEQ ID NO: 310727 - DNA, 20 bp, Artificial Sequence
  Description of Artificial Sequence: Synthetic oligonucleotide
  Target: ATXN1; (+) strand; PAM type: YTN; PAM sequence: TTC
tatatgtaaggtcctaaaac

SEQ ID NO: 310728 - DNA, 20 bp, Artificial Sequence
  Description of Artificial Sequence: Synthetic oligonucleotide
  Target: ATXN1; (+) strand; PAM type: YTN; PAM sequence: CTA
tatgtaaggtcctaaaacag

SEQ ID NO: 310729 - DNA, 20 bp, Artificial Sequence
  Description of Artificial Sequence: Synthetic oligonucleotide
  Target: ATXN1; (+) strand; PAM type: YTN; PAM sequence: CTA
aaacagaaattattatttct

SEQ ID NO: 310730 - DNA, 20 bp, Artificial Sequence
  Description of Artificial Sequence: Synthetic oligonucleotide
  Target: ATXN1; (+) strand; PAM type: YTN; PAM sequence: TTA
ttatttctattaccatttct

SEQ ID NO: 310731 - DNA, 20 bp, Artificial Sequence
  Description of Artificial Sequence: Synthetic oligonucleotide
  Target: ATXN1; (+) strand; PAM type: YTN; PAM sequence: TTA
tttctattaccatttctaca

SEQ ID NO: 310732 - DNA, 20 bp, Artificial Sequence
  Description of Artificial Sequence: Synthetic oligonucleotide
  Target: ATXN1; (+) strand; PAM type: YTN; PAM sequence: TTT
ctattaccatttctacaatg

SEQ ID NO: 310733 - DNA, 20 bp, Artificial Sequence
  Description of Artificial Sequence: Synthetic oligonucleotide
  Target: ATXN1; (+) strand; PAM type: YTN; PAM sequence: TTC
tattaccatttctacaatgt

SEQ ID NO: 310734 - DNA, 20 bp, Artificial Sequence
  Description of Artificial Sequence: Synthetic oligonucleotide
  Target: ATXN1; (+) strand; PAM type: YTN; PAM sequence: CTA
ttaccatttctacaatgtat

SEQ ID NO: 310735 - DNA, 20 bp, Artificial Sequence
  Description of Artificial Sequence: Synthetic oligonucleotide
  Target: ATXN1; (+) strand; PAM type: YTN; PAM sequence: TTA
ccatttctacaatgtattgc

SEQ ID NO: 310736 - DNA, 20 bp, Artificial Sequence
  Description of Artificial Sequence: Synthetic oligonucleotide
  Target: ATXN1; (+) strand; PAM type: YTN; PAM sequence: TTT
ctacaatgtattgctttcaa

SEQ ID NO: 310737 - DNA, 20 bp, Artificial Sequence
  Description of Artificial Sequence: Synthetic oligonucleotide
  Target: ATXN1; (+) strand; PAM type: YTN; PAM sequence: TTC
tacaatgtattgctttcaat

SEQ ID NO: 310738 - DNA, 20 bp, Artificial Sequence
  Description of Artificial Sequence: Synthetic oligonucleotide
  Target: ATXN1; (+) strand; PAM type: YTN; PAM sequence: CTA
caatgtattgctttcaatgc

SEQ ID NO: 310739 - DNA, 20 bp, Artificial Sequence
  Description of Artificial Sequence: Synthetic oligonucleotide
  Target: ATXN1; (+) strand; PAM type: YTN; PAM sequence: TTG
ctttcaatgcttttatcaaa

SEQ ID NO: 310740 - DNA, 20 bp, Artificial Sequence
  Description of Artificial Sequence: Synthetic oligonucleotide
  Target: ATXN1; (+) strand; PAM type: YTN; PAM sequence: CTT
tcaatgcttttatcaaaata

SEQ ID NO: 310741 - DNA, 20 bp, Artificial Sequence
  Description of Artificial Sequence: Synthetic oligonucleotide
  Target: ATXN1; (+) strand; PAM type: YTN; PAM sequence: TTT
caatgcttttatcaaaataa

SEQ ID NO: 310742 - DNA, 20 bp, Artificial Sequence
  Description of Artificial Sequence: Synthetic oligonucleotide
  Target: ATXN1; (+) strand; PAM type: YTN; PAM sequence: TTC
aatgcttttatcaaaataag

SEQ ID NO: 310743 - DNA, 20 bp, Artificial Sequence
  Description of Artificial Sequence: Synthetic oligonucleotide
  Target: ATXN1; (+) strand; PAM type: YTN; PAM sequence: CTT
ttatcaaaataaggagggcc

SEQ ID NO: 310744 - DNA, 20 bp, Artificial Sequence
  Description of Artificial Sequence: Synthetic oligonucleotide
  Target: ATXN1; (+) strand; PAM type: YTN; PAM sequence: TTT
tatcaaaataaggagggcct

SEQ ID NO: 310745 - DNA, 20 bp, Artificial Sequence
  Description of Artificial Sequence: Synthetic oligonucleotide
  Target: ATXN1; (+) strand; PAM type: YTN; PAM sequence: TTT
atcaaaataaggagggcctg

SEQ ID NO: 310746 - DNA, 20 bp, Artificial Sequence
  Description of Artificial Sequence: Synthetic oligonucleotide
  Target: ATXN1; (+) strand; PAM type: YTN; PAM sequence: TTA
tcaaaataaggagggcctgc

SEQ ID NO: 310747 - DNA, 20 bp, Artificial Sequence
  Description of Artificial Sequence: Synthetic oligonucleotide
  Target: ATXN1; (+) strand; PAM type: YTN; PAM sequence: CTG
cttctgataaccttggaagt

SEQ ID NO: 310748 - DNA, 20 bp, Artificial Sequence
  Description of Artificial Sequence: Synthetic oligonucleotide
  Target: ATXN1; (+) strand; PAM type: YTN; PAM sequence: CTT
ctgataaccttggaagtatg

SEQ ID NO: 310749 - DNA, 20 bp, Artificial Sequence
  Description of Artificial Sequence: Synthetic oligonucleotide
  Target: ATXN1; (+) strand; PAM type: YTN; PAM sequence: TTC
tgataaccttggaagtatga

SEQ ID NO: 310750 - DNA, 20 bp, Artificial Sequence
  Description of Artificial Sequence: Synthetic oligonucleotide
  Target: ATXN1; (+) strand; PAM type: YTN; PAM sequence: CTG
ataaccttggaagtatgacc

SEQ ID NO: 310751 - DNA, 20 bp, Artificial Sequence
  Description of Artificial Sequence: Synthetic oligonucleotide
  Target: ATXN1; (+) strand; PAM type: YTN; PAM sequence: CTT
ggaagtatgaccagaactaa

SEQ ID NO: 310752 - DNA, 20 bp, Artificial Sequence
  Description of Artificial Sequence: Synthetic oligonucleotide
  Target: ATXN1; (+) strand; PAM type: YTN; PAM sequence: TTG
gaagtatgaccagaactaaa

SEQ ID NO: 310753 - DNA, 20 bp, Artificial Sequence
  Description of Artificial Sequence: Synthetic oligonucleotide
  Target: ATXN1; (+) strand; PAM type: YTN; PAM sequence: CTA
aatctgttatttgaagcaat

SEQ ID NO: 310754 - DNA, 20 bp, Artificial Sequence
  Description of Artificial Sequence: Synthetic oligonucleotide
  Target: ATXN1; (+) strand; PAM type: YTN; PAM sequence: CTG
ttatttgaagcaattaagct

SEQ ID NO: 310755 - DNA, 20 bp, Artificial Sequence
  Description of Artificial Sequence: Synthetic oligonucleotide
  Target: ATXN1; (+) strand; PAM type: YTN; PAM sequence: TTA
tttgaagcaattaagctgca

SEQ ID NO: 310756 - DNA, 20 bp, Artificial Sequence
  Description of Artificial Sequence: Synthetic oligonucleotide
  Target: ATXN1; (+) strand; PAM type: YTN; PAM sequence: TTT
gaagcaattaagctgcacag

SEQ ID NO: 310757 - DNA, 20 bp, Artificial Sequence
  Description of Artificial Sequence: Synthetic oligonucleotide
  Target: ATXN1; (+) strand; PAM type: YTN; PAM sequence: TTG
aagcaattaagctgcacaga

SEQ ID NO: 310758 - DNA, 20 bp, Artificial Sequence
  Description of Artificial Sequence: Synthetic oligonucleotide
  Target: ATXN1; (+) strand; PAM type: YTN; PAM sequence: TTA
agctgcacagatctaaatct

SEQ ID NO: 310759 - DNA, 20 bp, Artificial Sequence
  Description of Artificial Sequence: Synthetic oligonucleotide
  Target: ATXN1; (+) strand; PAM type: YTN; PAM sequence: CTG
cacagatctaaatctctcac

SEQ ID NO: 310760 - DNA, 20 bp, Artificial Sequence
  Description of Artificial Sequence: Synthetic oligonucleotide
  Target: ATXN1; (+) strand; PAM type: YTN; PAM sequence: CTA
aatctctcacagaaactaat

SEQ ID NO: 310761 - DNA, 20 bp, Artificial Sequence
  Description of Artificial Sequence: Synthetic oligonucleotide
  Target: ATXN1; (+) strand; PAM type: YTN; PAM sequence: CTC
tcacagaaactaatcattcg

SEQ ID NO: 310762 - DNA, 20 bp, Artificial Sequence
  Description of Artificial Sequence: Synthetic oligonucleotide
  Target: ATXN1; (+) strand; PAM type: YTN; PAM sequence: CTC
acagaaactaatcattcgaa

SEQ ID NO: 310763 - DNA, 20 bp, Artificial Sequence
  Description of Artificial Sequence: Synthetic oligonucleotide
  Target: ATXN1; (+) strand; PAM type: YTN; PAM sequence: CTA
atcattcgaactattgaatt

SEQ ID NO: 310764 - DNA, 20 bp, Artificial Sequence
  Description of Artificial Sequence: Synthetic oligonucleotide
  Target: ATXN1; (+) strand; PAM type: YTN; PAM sequence: TTC
gaactattgaattactctga

SEQ ID NO: 310765 - DNA, 20 bp, Artificial Sequence
  Description of Artificial Sequence: Synthetic oligonucleotide
  Target: ATXN1; (+) strand; PAM type: YTN; PAM sequence: CTA
ttgaattactctgaaaatac

SEQ ID NO: 310766 - DNA, 20 bp, Artificial Sequence
  Description of Artificial Sequence: Synthetic oligonucleotide
  Target: ATXN1; (+) strand; PAM type: YTN; PAM sequence: TTG
aattactctgaaaatacaga

SEQ ID NO: 310767 - DNA, 20 bp, Artificial Sequence
  Description of Artificial Sequence: Synthetic oligonucleotide
  Target: ATXN1; (+) strand; PAM type: YTN; PAM sequence: TTA
ctctgaaaatacagagcaag

SEQ ID NO: 310768 - DNA, 20 bp, Artificial Sequence
  Description of Artificial Sequence: Synthetic oligonucleotide
  Target: ATXN1; (+) strand; PAM type: YTN; PAM sequence: CTC
tgaaaatacagagcaaggaa

SEQ ID NO: 310769 - DNA, 20 bp, Artificial Sequence
  Description of Artificial Sequence: Synthetic oligonucleotide
  Target: ATXN1; (+) strand; PAM type: YTN; PAM sequence: CTG
aaaatacagagcaaggaaag

SEQ ID NO: 310770 - DNA, 20 bp, Artificial Sequence
  Description of Artificial Sequence: Synthetic oligonucleotide
  Target: ATXN1; (+) strand; PAM type: YTN; PAM sequence: CTA
tctctcccctaaaaataata

SEQ ID NO: 310771 - DNA, 20 bp, Artificial Sequence
  Description of Artificial Sequence: Synthetic oligonucleotide
  Target: ATXN1; (+) strand; PAM type: YTN; PAM sequence: CTC
tcccctaaaaataatagcct

SEQ ID NO: 310772 - DNA, 20 bp, Artificial Sequence
  Description of Artificial Sequence: Synthetic oligonucleotide
  Target: ATXN1; (+) strand; PAM type: YTN; PAM sequence: CTC
ccctaaaaataatagcctgt

SEQ ID NO: 310773 - DNA, 20 bp, Artificial Sequence
  Description of Artificial Sequence: Synthetic oligonucleotide
  Target: ATXN1; (+) strand; PAM type: YTN; PAM sequence: CTA
aaaataatagcctgtcttac

SEQ ID NO: 310774 - DNA, 20 bp, Artificial Sequence
  Description of Artificial Sequence: Synthetic oligonucleotide
  Target: ATXN1; (+) strand; PAM type: YTN; PAM sequence: CTG
tcttacttcactattgtcac

SEQ ID NO: 310775 - DNA, 20 bp, Artificial Sequence
  Description of Artificial Sequence: Synthetic oligonucleotide
  Target: ATXN1; (+) strand; PAM type: YTN; PAM sequence: CTT
acttcactattgtcacttta

SEQ ID NO: 310776 - DNA, 20 bp, Artificial Sequence
  Description of Artificial Sequence: Synthetic oligonucleotide
  Target: ATXN1; (+) strand; PAM type: YTN; PAM sequence: TTA
cttcactattgtcactttac

SEQ ID NO: 310777 - DNA, 20 bp, Artificial Sequence
  Description of Artificial Sequence: Synthetic oligonucleotide
  Target: ATXN1; (+) strand; PAM type: YTN; PAM sequence: CTT
cactattgtcactttaccga

SEQ ID NO: 310778 - DNA, 20 bp, Artificial Sequence
  Description of Artificial Sequence: Synthetic oligonucleotide
  Target: ATXN1; (+) strand; PAM type: YTN; PAM sequence: TTC
actattgtcactttaccgat

SEQ ID NO: 310779 - DNA, 20 bp, Artificial Sequence
  Description of Artificial Sequence: Synthetic oligonucleotide
  Target: ATXN1; (+) strand; PAM type: YTN; PAM sequence: CTA
ttgtcactttaccgatgcaa

SEQ ID NO: 310780 - DNA, 20 bp, Artificial Sequence
  Description of Artificial Sequence: Synthetic oligonucleotide
  Target: ATXN1; (+) strand; PAM type: YTN; PAM sequence: TTG
tcactttaccgatgcaagta

SEQ ID NO: 310781 - DNA, 20 bp, Artificial Sequence
  Description of Artificial Sequence: Synthetic oligonucleotide
  Target: ATXN1; (+) strand; PAM type: YTN; PAM sequence: CTT
taccgatgcaagtatttaag

SEQ ID NO: 310782 - DNA, 20 bp, Artificial Sequence
  Description of Artificial Sequence: Synthetic oligonucleotide
  Target: ATXN1; (+) strand; PAM type: YTN; PAM sequence: TTT
accgatgcaagtatttaagc

SEQ ID NO: 310783 - DNA, 20 bp, Artificial Sequence
  Description of Artificial Sequence: Synthetic oligonucleotide
  Target: ATXN1; (+) strand; PAM type: YTN; PAM sequence: TTA
ccgatgcaagtatttaagct

SEQ ID NO: 310784 - DNA, 20 bp, Artificial Sequence
  Description of Artificial Sequence: Synthetic oligonucleotide
  Target: ATXN1; (+) strand; PAM type: YTN; PAM sequence: TTT
aagctgttcagatcctaatc

SEQ ID NO: 310785 - DNA, 20 bp, Artificial Sequence
  Description of Artificial Sequence: Synthetic oligonucleotide
  Target: ATXN1; (+) strand; PAM type: YTN; PAM sequence: TTA
agctgttcagatcctaatct

SEQ ID NO: 310786 - DNA, 20 bp, Artificial Sequence
  Description of Artificial Sequence: Synthetic oligonucleotide
  Target: ATXN1; (+) strand; PAM type: YTN; PAM sequence: CTG
ttcagatcctaatctatgtg

SEQ ID NO: 310787 - DNA, 20 bp, Artificial Sequence
  Description of Artificial Sequence: Synthetic oligonucleotide
  Target: ATXN1; (+) strand; PAM type: YTN; PAM sequence: TTC
agatcctaatctatgtgtta

SEQ ID NO: 310788 - DNA, 20 bp, Artificial Sequence
  Description of Artificial Sequence: Synthetic oligonucleotide
  Target: ATXN1; (+) strand; PAM type: YTN; PAM sequence: CTA
atctatgtgttattttcaga

SEQ ID NO: 310789 - DNA, 20 bp, Artificial Sequence
  Description of Artificial Sequence: Synthetic oligonucleotide
  Target: ATXN1; (+) strand; PAM type: YTN; PAM sequence: CTA
tgtgttattttcagataact

SEQ ID NO: 310790 - DNA, 20 bp, Artificial Sequence
  Description of Artificial Sequence: Synthetic oligonucleotide
  Target: ATXN1; (+) strand; PAM type: YTN; PAM sequence: TTA
ttttcagataactacagttt

SEQ ID NO: 310791 - DNA, 20 bp, Artificial Sequence
  Description of Artificial Sequence: Synthetic oligonucleotide
  Target: ATXN1; (+) strand; PAM type: YTN; PAM sequence: TTT
tcagataactacagtttaaa

SEQ ID NO: 310792 - DNA, 20 bp, Artificial Sequence
  Description of Artificial Sequence: Synthetic oligonucleotide
  Target: ATXN1; (+) strand; PAM type: YTN; PAM sequence: TTT
cagataactacagtttaaag

SEQ ID NO: 310793 - DNA, 20 bp, Artificial Sequence
  Description of Artificial Sequence: Synthetic oligonucleotide
  Target: ATXN1; (+) strand; PAM type: YTN; PAM sequence: TTC
agataactacagtttaaaga

SEQ ID NO: 310794 - DNA, 20 bp, Artificial Sequence
  Description of Artificial Sequence: Synthetic oligonucleotide
  Target: ATXN1; (+) strand; PAM type: YTN; PAM sequence: CTA
cagtttaaagaattaacatt

SEQ ID NO: 310795 - DNA, 20 bp, Artificial Sequence
  Description of Artificial Sequence: Synthetic oligonucleotide
  Target: ATXN1; (+) strand; PAM type: YTN; PAM sequence: TTT
aaagaattaacattcactcc

SEQ ID NO: 310796 - DNA, 20 bp, Artificial Sequence
  Description of Artificial Sequence: Synthetic oligonucleotide
  Target: ATXN1; (+) strand; PAM type: YTN; PAM sequence: TTA
aagaattaacattcactccc

SEQ ID NO: 310797 - DNA, 20 bp, Artificial Sequence
  Description of Artificial Sequence: Synthetic oligonucleotide
  Target: ATXN1; (+) strand; PAM type: YTN; PAM sequence: TTA
acattcactcccacatttac

SEQ ID NO: 310798 - DNA, 20 bp, Artificial Sequence
  Description of Artificial Sequence: Synthetic oligonucleotide
  Target: ATXN1; (+) strand; PAM type: YTN; PAM sequence: TTC
actcccacatttacctactt

SEQ ID NO: 310799 - DNA, 20 bp, Artificial Sequence
  Description of Artificial Sequence: Synthetic oligonucleotide
  Target: ATXN1; (+) strand; PAM type: YTN; PAM sequence: CTC
ccacatttacctacttacgt

SEQ ID NO: 310800 - DNA, 20 bp, Artificial Sequence
  Description of Artificial Sequence: Synthetic oligonucleotide
  Target: ATXN1; (+) strand; PAM type: YTN; PAM sequence: TTT
acctacttacgtgagtttca

SEQ ID NO: 310801 - DNA, 20 bp, Artificial Sequence
  Description of Artificial Sequence: Synthetic oligonucleotide
  Target: ATXN1; (+) strand; PAM type: YTN; PAM sequence: TTA
cctacttacgtgagtttcag

SEQ ID NO: 310802 - DNA, 20 bp, Artificial Sequence
  Description of Artificial Sequence: Synthetic oligonucleotide
  Target: ATXN1; (+) strand; PAM type: YTN; PAM sequence: CTA
cttacgtgagtttcagaatt

SEQ ID NO: 310803 - DNA, 20 bp, Artificial Sequence
  Description of Artificial Sequence: Synthetic oligonucleotide
  Target: ATXN1; (+) strand; PAM type: YTN; PAM sequence: CTT
acgtgagtttcagaatttta

SEQ ID NO: 310804 - DNA, 20 bp, Artificial Sequence
  Description of Artificial Sequence: Synthetic oligonucleotide
  Target: ATXN1; (+) strand; PAM type: YTN; PAM sequence: TTA
cgtgagtttcagaattttag

SEQ ID NO: 310805 - DNA, 20 bp, Artificial Sequence
  Description of Artificial Sequence: Synthetic oligonucleotide
  Target: ATXN1; (+) strand; PAM type: YTN; PAM sequence: TTT
cagaattttagtaaaatatg

SEQ ID NO: 310806 - DNA, 20 bp, Artificial Sequence
  Description of Artificial Sequence: Synthetic oligonucleotide
  Target: ATXN1; (+) strand; PAM type: YTN; PAM sequence: TTC
agaattttagtaaaatatgt

SEQ ID NO: 310807 - DNA, 20 bp, Artificial Sequence
  Description of Artificial Sequence: Synthetic oligonucleotide
  Target: ATXN1; (+) strand; PAM type: YTN; PAM sequence: TTT
tagtaaaatatgtttattgc

SEQ ID NO: 310808 - DNA, 20 bp, Artificial Sequence
  Description of Artificial Sequence: Synthetic oligonucleotide
  Target: ATXN1; (+) strand; PAM type: YTN; PAM sequence: TTT
agtaaaatatgtttattgct

SEQ ID NO: 310809 - DNA, 20 bp, Artificial Sequence
  Description of Artificial Sequence: Synthetic oligonucleotide
  Target: ATXN1; (+) strand; PAM type: YTN; PAM sequence: TTA
gtaaaatatgtttattgctt

SEQ ID NO: 310810 - DNA, 20 bp, Artificial Sequence
  Description of Artificial Sequence: Synthetic oligonucleotide
  Target: ATXN1; (+) strand; PAM type: YTN; PAM sequence: TTT
attgcttaacttttaatagg

SEQ ID NO: 310811 - DNA, 20 bp, Artificial Sequence
  Description of Artificial Sequence: Synthetic oligonucleotide
  Target: ATXN1; (+) strand; PAM type: YTN; PAM sequence: TTA
ttgcttaacttttaatagga

SEQ ID NO: 310812 - DNA, 20 bp, Artificial Sequence
  Description of Artificial Sequence: Synthetic oligonucleotide
  Target: ATXN1; (+) strand; PAM type: YTN; PAM sequence: TTG
cttaacttttaataggaaac

SEQ ID NO: 310813 - DNA, 20 bp, Artificial Sequence
  Description of Artificial Sequence: Synthetic oligonucleotide
  Target: ATXN1; (+) strand; PAM type: YTN; PAM sequence: CTT
aacttttaataggaaacaaa

SEQ ID NO: 310814 - DNA, 20 bp, Artificial Sequence
  Description of Artificial Sequence: Synthetic oligonucleotide
  Target: ATXN1; (+) strand; PAM type: YTN; PAM sequence: TTA
acttttaataggaaacaaaa

SEQ ID NO: 310815 - DNA, 20 bp, Artificial Sequence
  Description of Artificial Sequence: Synthetic oligonucleotide
  Target: ATXN1; (+) strand; PAM type: YTN; PAM sequence: CTT
ttaataggaaacaaaatgag

SEQ ID NO: 310816 - DNA, 20 bp, Artificial Sequence
  Description of Artificial Sequence: Synthetic oligonucleotide
  Target: ATXN1; (+) strand; PAM type: YTN; PAM sequence: TTT
taataggaaacaaaatgagt

SEQ ID NO: 310817 - DNA, 20 bp, Artificial Sequence
  Description of Artificial Sequence: Synthetic oligonucleotide
  Target: ATXN1; (+) strand; PAM type: YTN; PAM sequence: TTT
aataggaaacaaaatgagtg

SEQ ID NO: 310818 - DNA, 20 bp, Artificial Sequence
  Description of Artificial Sequence: Synthetic oligonucleotide
  Target: ATXN1; (+) strand; PAM type: YTN; PAM sequence: TTA
ataggaaacaaaatgagtgt

SEQ ID NO: 310819 - DNA, 20 bp, Artificial Sequence
  Description of Artificial Sequence: Synthetic oligonucleotide
  Target: ATXN1; (+) strand; PAM type: YTN; PAM sequence: TTA
gtgttagtcatcagaaactg

SEQ ID NO: 310820 - DNA, 20 bp, Artificial Sequence
  Description of Artificial Sequence: Synthetic oligonucleotide
  Target: ATXN1; (+) strand; PAM type: YTN; PAM sequence: TTA
gtcatcagaaactgtcactc

SEQ ID NO: 310821 - DNA, 20 bp, Artificial Sequence
  Description of Artificial Sequence: Synthetic oligonucleotide
  Target: ATXN1; (+) strand; PAM type: YTN; PAM sequence: CTG
tcactcaaggtatgtgcaaa

SEQ ID NO: 310822 - DNA, 20 bp, Artificial Sequence
  Description of Artificial Sequence: Synthetic oligonucleotide
  Target: ATXN1; (+) strand; PAM type: YTN; PAM sequence: CTC
aaggtatgtgcaaaaaagta

SEQ ID NO: 310823 - DNA, 20 bp, Artificial Sequence
  Description of Artificial Sequence: Synthetic oligonucleotide
  Target: ATXN1; (+) strand; PAM type: YTN; PAM sequence: CTT
gacatttcagaatgaaaaac

SEQ ID NO: 310824 - DNA, 20 bp, Artificial Sequence
  Description of Artificial Sequence: Synthetic oligonucleotide
  Target: ATXN1; (+) strand; PAM type: YTN; PAM sequence: TTG
acatttcagaatgaaaaaca

SEQ ID NO: 310825 - DNA, 20 bp, Artificial Sequence
  Description of Artificial Sequence: Synthetic oligonucleotide
  Target: ATXN1; (+) strand; PAM type: YTN; PAM sequence: TTT
cagaatgaaaaacaataaag

SEQ ID NO: 310826 - DNA, 20 bp, Artificial Sequence
  Description of Artificial Sequence: Synthetic oligonucleotide
  Target: ATXN1; (+) strand; PAM type: YTN; PAM sequence: TTC
agaatgaaaaacaataaagg

SEQ ID NO: 310827 - DNA, 20 bp, Artificial Sequence
  Description of Artificial Sequence: Synthetic oligonucleotide
  Target: ATXN1; (+) strand; PAM type: YTN; PAM sequence: TTA
ttcaaagaaatgtgcgtcct

SEQ ID NO: 310828 - DNA, 20 bp, Artificial Sequence
  Description of Artificial Sequence: Synthetic oligonucleotide
  Target: ATXN1; (+) strand; PAM type: YTN; PAM sequence: TTC
aaagaaatgtgcgtccttgg

SEQ ID NO: 310829 - DNA, 20 bp, Artificial Sequence
  Description of Artificial Sequence: Synthetic oligonucleotide
  Target: ATXN1; (+) strand; PAM type: YTN; PAM sequence: CTT
ggactccataatgacaacaa

SEQ ID NO: 310830 - DNA, 20 bp, Artificial Sequence
  Description of Artificial Sequence: Synthetic oligonucleotide
  Target: ATXN1; (+) strand; PAM type: YTN; PAM sequence: TTG
gactccataatgacaacaaa

SEQ ID NO: 310831 - DNA, 20 bp, Artificial Sequence
  Description of Artificial Sequence: Synthetic oligonucleotide
  Target: ATXN1; (+) strand; PAM type: YTN; PAM sequence: CTC
cataatgacaacaaaaacag

SEQ ID NO: 310832 - DNA, 20 bp, Artificial Sequence
  Description of Artificial Sequence: Synthetic oligonucleotide
  Target: ATXN1; (+) strand; PAM type: YTN; PAM sequence: TTT
actaatatttcaataatctc

SEQ ID NO: 310833 - DNA, 20 bp, Artificial Sequence
  Description of Artificial Sequence: Synthetic oligonucleotide
  Target: ATXN1; (+) strand; PAM type: YTN; PAM sequence: TTA
ctaatatttcaataatctca

SEQ ID NO: 310834 - DNA, 20 bp, Artificial Sequence
  Description of Artificial Sequence: Synthetic oligonucleotide
  Target: ATXN1; (+) strand; PAM type: YTN; PAM sequence: CTA
atatttcaataatctcagca

SEQ ID NO: 310835 - DNA, 20 bp, Artificial Sequence
  Description of Artificial Sequence: Synthetic oligonucleotide
  Target: ATXN1; (+) strand; PAM type: YTN; PAM sequence: TTT
caataatctcagcactggcc

SEQ ID NO: 310836 - DNA, 20 bp, Artificial Sequence
  Description of Artificial Sequence: Synthetic oligonucleotide
  Target: ATXN1; (+) strand; PAM type: YTN; PAM sequence: TTC
aataatctcagcactggcct

SEQ ID NO: 310837 - DNA, 20 bp, Artificial Sequence
  Description of Artificial Sequence: Synthetic oligonucleotide
  Target: ATXN1; (+) strand; PAM type: YTN; PAM sequence: CTC
agcactggcctttcccagga

SEQ ID NO: 310838 - DNA, 20 bp, Artificial Sequence
  Description of Artificial Sequence: Synthetic oligonucleotide
  Target: ATXN1; (+) strand; PAM type: YTN; PAM sequence: CTG
gcctttcccaggactcctag

SEQ ID NO: 310839 - DNA, 20 bp, Artificial Sequence
  Description of Artificial Sequence: Synthetic oligonucleotide
  Target: ATXN1; (+) strand; PAM type: YTN; PAM sequence: CTT
tcccaggactcctaggcaac

SEQ ID NO: 310840 - DNA, 20 bp, Artificial Sequence
  Description of Artificial Sequence: Synthetic oligonucleotide
  Target: ATXN1; (+) strand; PAM type: YTN; PAM sequence: TTT
cccaggactcctaggcaact

SEQ ID NO: 310841 - DNA, 20 bp, Artificial Sequence
  Description of Artificial Sequence: Synthetic oligonucleotide
  Target: ATXN1; (+) strand; PAM type: YTN; PAM sequence: TTC
ccaggactcctaggcaactg

SEQ ID NO: 310842 - DNA, 20 bp, Artificial Sequence
  Description of Artificial Sequence: Synthetic oligonucleotide
  Target: ATXN1; (+) strand; PAM type: YTN; PAM sequence: CTC
ctaggcaactgacttaggta

SEQ ID NO: 310843 - DNA, 20 bp, Artificial Sequence
  Description of Artificial Sequence: Synthetic oligonucleotide
  Target: ATXN1; (+) strand; PAM type: YTN; PAM sequence: CTA
ggcaactgacttaggtatgt

SEQ ID NO: 310844 - DNA, 20 bp, Artificial Sequence
  Description of Artificial Sequence: Synthetic oligonucleotide
  Target: ATXN1; (+) strand; PAM type: YTN; PAM sequence: CTG
acttaggtatgttgaaactt

SEQ ID NO: 310845 - DNA, 20 bp, Artificial Sequence
  Description of Artificial Sequence: Synthetic oligonucleotide
  Target: ATXN1; (+) strand; PAM type: YTN; PAM sequence: CTT
aggtatgttgaaacttacag

SEQ ID NO: 310846 - DNA, 20 bp, Artificial Sequence
  Description of Artificial Sequence: Synthetic oligonucleotide
  Target: ATXN1; (+) strand; PAM type: YTN; PAM sequence: TTA
ggtatgttgaaacttacagg

SEQ ID NO: 310847 - DNA, 20 bp, Artificial Sequence
  Description of Artificial Sequence: Synthetic oligonucleotide
  Target: ATXN1; (+) strand; PAM type: YTN; PAM sequence: TTG
aaacttacaggcatttgaca

SEQ ID NO: 310848 - DNA, 20 bp, Artificial Sequence
  Description of Artificial Sequence: Synthetic oligonucleotide
  Target: ATXN1; (+) strand; PAM type: YTN; PAM sequence: CTT
acaggcatttgacatgtaat

SEQ ID NO: 310849 - DNA, 20 bp, Artificial Sequence
  Description of Artificial Sequence: Synthetic oligonucleotide
  Target: ATXN1; (+) strand; PAM type: YTN; PAM sequence: TTA
caggcatttgacatgtaatc

SEQ ID NO: 310850 - DNA, 20 bp, Artificial Sequence
  Description of Artificial Sequence: Synthetic oligonucleotide
  Target: ATXN1; (+) strand; PAM type: YTN; PAM sequence: TTT
gacatgtaatcttgtggcta

SEQ ID NO: 310851 - DNA, 20 bp, Artificial Sequence
  Description of Artificial Sequence: Synthetic oligonucleotide
  Target: ATXN1; (+) strand; PAM type: YTN; PAM sequence: TTG
acatgtaatcttgtggctaa

SEQ ID NO: 310852 - DNA, 20 bp, Artificial Sequence
  Description of Artificial Sequence: Synthetic oligonucleotide
  Target: ATXN1; (+) strand; PAM type: YTN; PAM sequence: CTT
gtggctaaagagtttctgtt

SEQ ID NO: 310853 - DNA, 20 bp, Artificial Sequence
  Description of Artificial Sequence: Synthetic oligonucleotide
  Target: ATXN1; (+) strand; PAM type: YTN; PAM sequence: TTG
tggctaaagagtttctgttt

SEQ ID NO: 310854 - DNA, 20 bp, Artificial Sequence
  Description of Artificial Sequence: Synthetic oligonucleotide
  Target: ATXN1; (+) strand; PAM type: YTN; PAM sequence: CTA
aagagtttctgtttaatctt

SEQ ID NO: 310855 - DNA, 20 bp, Artificial Sequence
  Description of Artificial Sequence: Synthetic oligonucleotide
  Target: ATXN1; (+) strand; PAM type: YTN; PAM sequence: TTT
ctgtttaatcttcctctaag

SEQ ID NO: 310856 - DNA, 20 bp, Artificial Sequence
  Description of Artificial Sequence: Synthetic oligonucleotide
  Target: ATXN1; (+) strand; PAM type: YTN; PAM sequence: TTC
tgtttaatcttcctctaagt

SEQ ID NO: 310857 - DNA, 20 bp, Artificial Sequence
  Description of Artificial Sequence: Synthetic oligonucleotide
  Target: ATXN1; (+) strand; PAM type: YTN; PAM sequence: CTG
tttaatcttcctctaagtgt

SEQ ID NO: 310858 - DNA, 20 bp, Artificial Sequence
  Description of Artificial Sequence: Synthetic oligonucleotide
  Target: ATXN1; (+) strand; PAM type: YTN; PAM sequence: TTT
aatcttcctctaagtgtaaa

SEQ ID NO: 310859 - DNA, 20 bp, Artificial Sequence
  Description of Artificial Sequence: Synthetic oligonucleotide
  Target: ATXN1; (+) strand; PAM type: YTN; PAM sequence: TTA
atcttcctctaagtgtaaaa

SEQ ID NO: 310860 - DNA, 20 bp, Artificial Sequence
  Description of Artificial Sequence: Synthetic oligonucleotide
  Target: ATXN1; (+) strand; PAM type: YTN; PAM sequence: CTT
cctctaagtgtaaaagacaa

SEQ ID NO: 310861 - DNA, 20 bp, Artificial Sequence
  Description of Artificial Sequence: Synthetic oligonucleotide
  Target: ATXN1; (+) strand; PAM type: YTN; PAM sequence: TTC
ctctaagtgtaaaagacaat

SEQ ID NO: 310862 - DNA, 20 bp, Artificial Sequence
  Description of Artificial Sequence: Synthetic oligonucleotide
  Target: ATXN1; (+) strand; PAM type: YTN; PAM sequence: CTC
taagtgtaaaagacaattca

SEQ ID NO: 310863 - DNA, 20 bp, Artificial Sequence
  Description of Artificial Sequence: Synthetic oligonucleotide
  Target: ATXN1; (+) strand; PAM type: YTN; PAM sequence: CTA
agtgtaaaagacaattcaga

SEQ ID NO: 310864 - DNA, 20 bp, Artificial Sequence
  Description of Artificial Sequence: Synthetic oligonucleotide
  Target: ATXN1; (+) strand; PAM type: YTN; PAM sequence: TTC
agaagtcctgaagtctagtc

SEQ ID NO: 310865 - DNA, 20 bp, Artificial Sequence
  Description of Artificial Sequence: Synthetic oligonucleotide
  Target: ATXN1; (+) strand; PAM type: YTN; PAM sequence: CTG
aagtctagtcgtaacatttt

SEQ ID NO: 310866 - DNA, 20 bp, Artificial Sequence
  Description of Artificial Sequence: Synthetic oligonucleotide
  Target: ATXN1; (+) strand; PAM type: YTN; PAM sequence: CTA
gtcgtaacatttttgacaaa

SEQ ID NO: 310867 - DNA, 20 bp, Artificial Sequence
  Description of Artificial Sequence: Synthetic oligonucleotide
  Target: ATXN1; (+) strand; PAM type: YTN; PAM sequence: TTT
ttgacaaagtgtcacttctg

SEQ ID NO: 310868 - DNA, 20 bp, Artificial Sequence
  Description of Artificial Sequence: Synthetic oligonucleotide
  Target: ATXN1; (+) strand; PAM type: YTN; PAM sequence: TTT
tgacaaagtgtcacttctgt

SEQ ID NO: 310869 - DNA, 20 bp, Artificial Sequence
  Description of Artificial Sequence: Synthetic oligonucleotide
  Target: ATXN1; (+) strand; PAM type: YTN; PAM sequence: TTT
gacaaagtgtcacttctgtt

SEQ ID NO: 310870 - DNA, 20 bp, Artificial Sequence
  Description of Artificial Sequence: Synthetic oligonucleotide
  Target: ATXN1; (+) strand; PAM type: YTN; PAM sequence: TTG
acaaagtgtcacttctgttt

SEQ ID NO: 310871 - DNA, 20 bp, Artificial Sequence
  Description of Artificial Sequence: Synthetic oligonucleotide
  Target: ATXN1; (+) strand; PAM type: YTN; PAM sequence: CTT
ctgtttaccaaaccctctta

SEQ ID NO: 310872 - DNA, 20 bp, Artificial Sequence
  Description of Artificial Sequence: Synthetic oligonucleotide
  Target: ATXN1; (+) strand; PAM type: YTN; PAM sequence: TTC
tgtttaccaaaccctcttaa

SEQ ID NO: 310873 - DNA, 20 bp, Artificial Sequence
  Description of Artificial Sequence: Synthetic oligonucleotide
  Target: ATXN1; (+) strand; PAM type: YTN; PAM sequence: CTG
tttaccaaaccctcttaaaa

SEQ ID NO: 310874 - DNA, 20 bp, Artificial Sequence
  Description of Artificial Sequence: Synthetic oligonucleotide
  Target: ATXN1; (+) strand; PAM type: YTN; PAM sequence: TTT
accaaaccctcttaaaacga

SEQ ID NO: 310875 - DNA, 20 bp, Artificial Sequence
  Description of Artificial Sequence: Synthetic oligonucleotide
  Target: ATXN1; (+) strand; PAM type: YTN; PAM sequence: TTA
ccaaaccctcttaaaacgaa

SEQ ID NO: 310876 - DNA, 20 bp, Artificial Sequence
  Description of Artificial Sequence: Synthetic oligonucleotide
  Target: ATXN1; (+) strand; PAM type: YTN; PAM sequence: CTC
ttaaaacgaaatccgcaagg

SEQ ID NO: 310877 - DNA, 20 bp, Artificial Sequence
  Description of Artificial Sequence: Synthetic oligonucleotide
  Target: ATXN1; (+) strand; PAM type: YTN; PAM sequence: CTT
aaaacgaaatccgcaaggaa

SEQ ID NO: 310878 - DNA, 20 bp, Artificial Sequence
  Description of Artificial Sequence: Synthetic oligonucleotide
  Target: ATXN1; (+) strand; PAM type: YTN; PAM sequence: TTA
aaacgaaatccgcaaggaaa

SEQ ID NO: 310879 - DNA, 20 bp, Artificial Sequence
  Description of Artificial Sequence: Synthetic oligonucleotide
  Target: ATXN1; (+) strand; PAM type: YTN; PAM sequence: TTG
cctttggcggttcccaccag

SEQ ID NO: 310880 - DNA, 20 bp, Artificial Sequence
  Description of Artificial Sequence: Synthetic oligonucleotide
  Target: ATXN1; (+) strand; PAM type: YTN; PAM sequence: CTT
tggcggttcccaccaggtac

SEQ ID NO: 310881 - DNA, 20 bp, Artificial Sequence
  Description of Artificial Sequence: Synthetic oligonucleotide
  Target: ATXN1; (+) strand; PAM type: YTN; PAM sequence: TTT
ggcggttcccaccaggtaca

SEQ ID NO: 310882 - DNA, 20 bp, Artificial Sequence
  Description of Artificial Sequence: Synthetic oligonucleotide
  Target: ATXN1; (+) strand; PAM type: YTN; PAM sequence: TTG
gcggttcccaccaggtacat

SEQ ID NO: 310883 - DNA, 20 bp, Artificial Sequence
  Description of Artificial Sequence: Synthetic oligonucleotide
  Target: ATXN1; (+) strand; PAM type: YTN; PAM sequence: TTC
ccaccaggtacattttttta

SEQ ID NO: 310884 - DNA, 20 bp, Artificial Sequence
  Description of Artificial Sequence: Synthetic oligonucleotide
  Target: ATXN1; (+) strand; PAM type: YTN; PAM sequence: TTT
ttttatacttattttcacat

SEQ ID NO: 310885 - DNA, 20 bp, Artificial Sequence
  Description of Artificial Sequence: Synthetic oligonucleotide
  Target: ATXN1; (+) strand; PAM type: YTN; PAM sequence: TTT
tttatacttattttcacatg

SEQ ID NO: 310886 - DNA, 20 bp, Artificial Sequence
  Description of Artificial Sequence: Synthetic oligonucleotide
  Target: ATXN1; (+) strand; PAM type: YTN; PAM sequence: TTT
ttatacttattttcacatga

SEQ ID NO: 310887 - DNA, 20 bp, Artificial Sequence
  Description of Artificial Sequence: Synthetic oligonucleotide
  Target: ATXN1; (+) strand; PAM type: YTN; PAM sequence: TTT
tatacttattttcacatgaa

SEQ ID NO: 310888 - DNA, 20 bp, Artificial Sequence
  Description of Artificial Sequence: Synthetic oligonucleotide
  Target: ATXN1; (+) strand; PAM type: YTN; PAM sequence: TTT
atacttattttcacatgaat

SEQ ID NO: 310889 - DNA, 20 bp, Artificial Sequence
  Description of Artificial Sequence: Synthetic oligonucleotide
  Target: ATXN1; (+) strand; PAM type: YTN; PAM sequence: TTA
tacttattttcacatgaatt

SEQ ID NO: 310890 - DNA, 20 bp, Artificial Sequence
  Description of Artificial Sequence: Synthetic oligonucleotide
  Target: ATXN1; (+) strand; PAM type: YTN; PAM sequence: CTT
attttcacatgaatttattt

SEQ ID NO: 310891 - DNA, 20 bp, Artificial Sequence
  Description of Artificial Sequence: Synthetic oligonucleotide
  Target: ATXN1; (+) strand; PAM type: YTN; PAM sequence: TTA
ttttcacatgaatttatttg

SEQ ID NO: 310892 - DNA, 20 bp, Artificial Sequence
  Description of Artificial Sequence: Synthetic oligonucleotide
  Target: ATXN1; (+) strand; PAM type: YTN; PAM sequence: TTT
tcacatgaatttatttgtgc

SEQ ID NO: 310893 - DNA, 20 bp, Artificial Sequence
  Description of Artificial Sequence: Synthetic oligonucleotide
  Target: ATXN1; (+) strand; PAM type: YTN; PAM sequence: TTT
cacatgaatttatttgtgca

SEQ ID NO: 310894 - DNA, 20 bp, Artificial Sequence
  Description of Artificial Sequence: Synthetic oligonucleotide
  Target: ATXN1; (+) strand; PAM type: YTN; PAM sequence: TTC
acatgaatttatttgtgcac

SEQ ID NO: 310895 - DNA, 20 bp, Artificial Sequence
  Description of Artificial Sequence: Synthetic oligonucleotide
  Target: ATXN1; (+) strand; PAM type: YTN; PAM sequence: TTT
atttgtgcactgaaaaatat

SEQ ID NO: 310896 - DNA, 20 bp, Artificial Sequence
  Description of Artificial Sequence: Synthetic oligonucleotide
  Target: ATXN1; (+) strand; PAM type: YTN; PAM sequence: TTA
tttgtgcactgaaaaatata

SEQ ID NO: 310897 - DNA, 20 bp, Artificial Sequence
  Description of Artificial Sequence: Synthetic oligonucleotide
  Target: ATXN1; (+) strand; PAM type: YTN; PAM sequence: TTT
gtgcactgaaaaatatatgt

SEQ ID NO: 310898 - DNA, 20 bp, Artificial Sequence
  Description of Artificial Sequence: Synthetic oligonucleotide
  Target: ATXN1; (+) strand; PAM type: YTN; PAM sequence: TTG
tgcactgaaaaatatatgtt

SEQ ID NO: 310899 - DNA, 20 bp, Artificial Sequence
  Description of Artificial Sequence: Synthetic oligonucleotide
  Target: ATXN1; (+) strand; PAM type: YTN; PAM sequence: CTG
aaaaatatatgttcacattt

SEQ ID NO: 310900 - DNA, 20 bp, Artificial Sequence
  Description of Artificial Sequence: Synthetic oligonucleotide
  Target: ATXN1; (+) strand; PAM type: YTN; PAM sequence: TTC
acattttactgcaagtaaag

SEQ ID NO: 310901 - DNA, 20 bp, Artificial Sequence
  Description of Artificial Sequence: Synthetic oligonucleotide
  Target: ATXN1; (+) strand; PAM type: YTN; PAM sequence: TTT
tactgcaagtaaagcatttt

SEQ ID NO: 310902 - DNA, 20 bp, Artificial Sequence
  Description of Artificial Sequence: Synthetic oligonucleotide
  Target: ATXN1; (+) strand; PAM type: YTN; PAM sequence: TTT
actgcaagtaaagcattttt

SEQ ID NO: 310903 - DNA, 20 bp, Artificial Sequence
  Description of Artificial Sequence: Synthetic oligonucleotide
  Target: ATXN1; (+) strand; PAM type: YTN; PAM sequence: TTA
ctgcaagtaaagcatttttc

SEQ ID NO: 310904 - DNA, 20 bp, Artificial Sequence
  Description of Artificial Sequence: Synthetic oligonucleotide
  Target: ATXN1; (+) strand; PAM type: YTN; PAM sequence: CTG
caagtaaagcatttttctat

SEQ ID NO: 310905 - DNA, 20 bp, Artificial Sequence
  Description of Artificial Sequence: Synthetic oligonucleotide
  Target: ATXN1; (+) strand; PAM type: YTN; PAM sequence: TTT
ttctatatgttgcaaaatag

SEQ ID NO: 310906 - DNA, 20 bp, Artificial Sequence
  Description of Artificial Sequence: Synthetic oligonucleotide
  Target: ATXN1; (+) strand; PAM type: YTN; PAM sequence: TTT
tctatatgttgcaaaataga

SEQ ID NO: 310907 - DNA, 20 bp, Artificial Sequence
  Description of Artificial Sequence: Synthetic oligonucleotide
  Target: ATXN1; (+) strand; PAM type: YTN; PAM sequence: TTT
ctatatgttgcaaaatagaa

SEQ ID NO: 310908 - DNA, 20 bp, Artificial Sequence
  Description of Artificial Sequence: Synthetic oligonucleotide
  Target: ATXN1; (+) strand; PAM type: YTN; PAM sequence: TTC
tatatgttgcaaaatagaat

SEQ ID NO: 310909 - DNA, 20 bp, Artificial Sequence
  Description of Artificial Sequence: Synthetic oligonucleotide
  Target: ATXN1; (+) strand; PAM type: YTN; PAM sequence: CTA
tatgttgcaaaatagaatcc

SEQ ID NO: 310910 - DNA, 20 bp, Artificial Sequence
  Description of Artificial Sequence: Synthetic oligonucleotide
  Target: ATXN1; (+) strand; PAM type: YTN; PAM sequence: TTG
caaaatagaatccaggacct

SEQ ID NO: 310911 - DNA, 20 bp, Artificial Sequence
  Description of Artificial Sequence: Synthetic oligonucleotide
  Target: ATXN1; (+) strand; PAM type: YTN; PAM sequence: CTC
caaggcattgtgtaatattg

SEQ ID NO: 310912 - DNA, 20 bp, Artificial Sequence
  Description of Artificial Sequence: Synthetic oligonucleotide
  Target: ATXN1; (+) strand; PAM type: YTN; PAM sequence: TTG
tgtaatattgacatccttgc

SEQ ID NO: 310913 - DNA, 20 bp, Artificial Sequence
  Description of Artificial Sequence: Synthetic oligonucleotide
  Target: ATXN1; (+) strand; PAM type: YTN; PAM sequence: TTG
acatccttgcttcccatcta

SEQ ID NO: 310914 - DNA, 20 bp, Artificial Sequence
  Description of Artificial Sequence: Synthetic oligonucleotide
  Target: ATXN1; (+) strand; PAM type: YTN; PAM sequence: CTT
gcttcccatctatttaccac

SEQ ID NO: 310915 - DNA, 20 bp, Artificial Sequence
  Description of Artificial Sequence: Synthetic oligonucleotide
  Target: ATXN1; (+) strand; PAM type: YTN; PAM sequence: TTG
cttcccatctatttaccacc

SEQ ID NO: 310916 - DNA, 20 bp, Artificial Sequence
  Description of Artificial Sequence: Synthetic oligonucleotide
  Target: ATXN1; (+) strand; PAM type: YTN; PAM sequence: CTT
cccatctatttaccacctta

SEQ ID NO: 310917 - DNA, 20 bp, Artificial Sequence
  Description of Artificial Sequence: Synthetic oligonucleotide
  Target: ATXN1; (+) strand; PAM type: YTN; PAM sequence: TTC
ccatctatttaccaccttat

SEQ ID NO: 310918 - DNA, 20 bp, Artificial Sequence
  Description of Artificial Sequence: Synthetic oligonucleotide
  Target: ATXN1; (+) strand; PAM type: YTN; PAM sequence: CTA
tttaccaccttataaaagtt

SEQ ID NO: 310919 - DNA, 20 bp, Artificial Sequence
  Description of Artificial Sequence: Synthetic oligonucleotide
  Target: ATXN1; (+) strand; PAM type: YTN; PAM sequence: TTT
accaccttataaaagttgag

SEQ ID NO: 310920 - DNA, 20 bp, Artificial Sequence
  Description of Artificial Sequence: Synthetic oligonucleotide
  Target: ATXN1; (+) strand; PAM type: YTN; PAM sequence: TTA
ccaccttataaaagttgagt

SEQ ID NO: 310921 - DNA, 20 bp, Artificial Sequence
  Description of Artificial Sequence: Synthetic oligonucleotide
  Target: ATXN1; (+) strand; PAM type: YTN; PAM sequence: CTT
ataaaagttgagtagctaga

SEQ ID NO: 310922 - DNA, 20 bp, Artificial Sequence
  Description of Artificial Sequence: Synthetic oligonucleotide
  Target: ATXN1; (+) strand; PAM type: YTN; PAM sequence: TTA
taaaagttgagtagctagaa

SEQ ID NO: 310923 - DNA, 20 bp, Artificial Sequence
  Description of Artificial Sequence: Synthetic oligonucleotide
  Target: ATXN1; (+) strand; PAM type: YTN; PAM sequence: TTG
agtagctagaagaaataata

SEQ ID NO: 310924 - DNA, 20 bp, Artificial Sequence
  Description of Artificial Sequence: Synthetic oligonucleotide
  Target: ATXN1; (+) strand; PAM type: YTN; PAM sequence: CTA
gaagaaataatagctcattt

SEQ ID NO: 310925 - DNA, 20 bp, Artificial Sequence
  Description of Artificial Sequence: Synthetic oligonucleotide
  Target: ATXN1; (+) strand; PAM type: YTN; PAM sequence: CTC
attttaactacagcagtgct

SEQ ID NO: 310926 - DNA, 20 bp, Artificial Sequence
  Description of Artificial Sequence: Synthetic oligonucleotide
  Target: ATXN1; (+) strand; PAM type: YTN; PAM sequence: TTT
taactacagcagtgcttcat

SEQ ID NO: 310927 - DNA, 20 bp, Artificial Sequence
  Description of Artificial Sequence: Synthetic oligonucleotide
  Target: ATXN1; (+) strand; PAM type: YTN; PAM sequence: TTT
aactacagcagtgcttcatc

SEQ ID NO: 310928 - DNA, 20 bp, Artificial Sequence
  Description of Artificial Sequence: Synthetic oligonucleotide
  Target: ATXN1; (+) strand; PAM type: YTN; PAM sequence: TTA
actacagcagtgcttcatct

SEQ ID NO: 310929 - DNA, 20 bp, Artificial Sequence
  Description of Artificial Sequence: Synthetic oligonucleotide
  Target: ATXN1; (+) strand; PAM type: YTN; PAM sequence: CTA
cagcagtgcttcatctgacc

SEQ ID NO: 310930 - DNA, 20 bp, Artificial Sequence
  Description of Artificial Sequence: Synthetic oligonucleotide
  Target: ATXN1; (+) strand; PAM type: YTN; PAM sequence: CTT
catctgaccaggccacaatg

SEQ ID NO: 310931 - DNA, 20 bp, Artificial Sequence
  Description of Artificial Sequence: Synthetic oligonucleotide
  Target: ATXN1; (+) strand; PAM type: YTN; PAM sequence: TTC
atctgaccaggccacaatga

SEQ ID NO: 310932 - DNA, 20 bp, Artificial Sequence
  Description of Artificial Sequence: Synthetic oligonucleotide
  Target: ATXN1; (+) strand; PAM type: YTN; PAM sequence: CTG
accaggccacaatgaattta

SEQ ID NO: 310933 - DNA, 20 bp, Artificial Sequence
  Description of Artificial Sequence: Synthetic oligonucleotide
  Target: ATXN1; (+) strand; PAM type: YTN; PAM sequence: TTT
accaaccacataaactcaca

SEQ ID NO: 310934 - DNA, 20 bp, Artificial Sequence
  Description of Artificial Sequence: Synthetic oligonucleotide
  Target: ATXN1; (+) strand; PAM type: YTN; PAM sequence: TTA
ccaaccacataaactcacaa

SEQ ID NO: 310935 - DNA, 20 bp, Artificial Sequence
  Description of Artificial Sequence: Synthetic oligonucleotide
  Target: ATXN1; (+) strand; PAM type: YTN; PAM sequence: CTC
acaaaacggtaaaaactcat

SEQ ID NO: 310936 - DNA, 20 bp, Artificial Sequence
  Description of Artificial Sequence: Synthetic oligonucleotide
  Target: ATXN1; (+) strand; PAM type: YTN; PAM sequence: CTC
ataaaccccctgggaataga

SEQ ID NO: 310937 - DNA, 20 bp, Artificial Sequence
  Description of Artificial Sequence: Synthetic oligonucleotide
  Target: ATXN1; (+) strand; PAM type: YTN; PAM sequence: CTG
ggaatagagttgagtagctc

SEQ ID NO: 310938 - DNA, 20 bp, Artificial Sequence
  Description of Artificial Sequence: Synthetic oligonucleotide
  Target: ATXN1; (+) strand; PAM type: YTN; PAM sequence: TTG
agtagctctctcaatcctag

SEQ ID NO: 310939 - DNA, 20 bp, Artificial Sequence
  Description of Artificial Sequence: Synthetic oligonucleotide
  Target: ATXN1; (+) strand; PAM type: YTN; PAM sequence: CTC
tctcaatcctagccctgggg

SEQ ID NO: 310940 - DNA, 20 bp, Artificial Sequence
  Description of Artificial Sequence: Synthetic oligonucleotide
  Target: ATXN1; (+) strand; PAM type: YTN; PAM sequence: CTC
tcaatcctagccctggggga

SEQ ID NO: 310941 - DNA, 20 bp, Artificial Sequence
  Description of Artificial Sequence: Synthetic oligonucleotide
  Target: ATXN1; (+) strand; PAM type: YTN; PAM sequence: CTC
aatcctagccctgggggaaa

SEQ ID NO: 310942 - DNA, 20 bp, Artificial Sequence
  Description of Artificial Sequence: Synthetic oligonucleotide
  Target: ATXN1; (+) strand; PAM type: YTN; PAM sequence: CTA
gccctgggggaaaaaattta

SEQ ID NO: 310943 - DNA, 20 bp, Artificial Sequence
  Description of Artificial Sequence: Synthetic oligonucleotide
  Target: ATXN1; (+) strand; PAM type: YTN; PAM sequence: CTG
ggggaaaaaatttaccagtt

SEQ ID NO: 310944 - DNA, 20 bp, Artificial Sequence
  Description of Artificial Sequence: Synthetic oligonucleotide
  Target: ATXN1; (+) strand; PAM type: YTN; PAM sequence: TTT
accagtttagctttgttggc

SEQ ID NO: 310945 - DNA, 20 bp, Artificial Sequence
  Description of Artificial Sequence: Synthetic oligonucleotide
  Target: ATXN1; (+) strand; PAM type: YTN; PAM sequence: TTA
ccagtttagctttgttggcc

SEQ ID NO: 310946 - DNA, 20 bp, Artificial Sequence
  Description of Artificial Sequence: Synthetic oligonucleotide
  Target: ATXN1; (+) strand; PAM type: YTN; PAM sequence: TTT
agctttgttggccataaaat

SEQ ID NO: 310947 - DNA, 20 bp, Artificial Sequence
  Description of Artificial Sequence: Synthetic oligonucleotide
  Target: ATXN1; (+) strand; PAM type: YTN; PAM sequence: TTA
gctttgttggccataaaatt

SEQ ID NO: 310948 - DNA, 20 bp, Artificial Sequence
  Description of Artificial Sequence: Synthetic oligonucleotide
  Target: ATXN1; (+) strand; PAM type: YTN; PAM sequence: CTT
tgttggccataaaattgtaa

SEQ ID NO: 310949 - DNA, 20 bp, Artificial Sequence
  Description of Artificial Sequence: Synthetic oligonucleotide
  Target: ATXN1; (+) strand; PAM type: YTN; PAM sequence: TTT
gttggccataaaattgtaaa

SEQ ID NO: 310950 - DNA, 20 bp, Artificial Sequence
  Description of Artificial Sequence: Synthetic oligonucleotide
  Target: ATXN1; (+) strand; PAM type: YTN; PAM sequence: TTG
ttggccataaaattgtaaac

SEQ ID NO: 310951 - DNA, 20 bp, Artificial Sequence
  Description of Artificial Sequence: Synthetic oligonucleotide
  Target: ATXN1; (+) strand; PAM type: YTN; PAM sequence: TTG
gccataaaattgtaaactga

SEQ ID NO: 310952 - DNA, 20 bp, Artificial Sequence
  Description of Artificial Sequence: Synthetic oligonucleotide
  Target: ATXN1; (+) strand; PAM type: YTN; PAM sequence: TTG
taaactgactggcagtcaca

SEQ ID NO: 310953 - DNA, 20 bp, Artificial Sequence
  Description of Artificial Sequence: Synthetic oligonucleotide
  Target: ATXN1; (+) strand; PAM type: YTN; PAM sequence: CTG
actggcagtcacaactaaat

SEQ ID NO: 310954 - DNA, 20 bp, Artificial Sequence
  Description of Artificial Sequence: Synthetic oligonucleotide
  Target: ATXN1; (+) strand; PAM type: YTN; PAM sequence: CTG
gcagtcacaactaaatcaag

SEQ ID NO: 310955 - DNA, 20 bp, Artificial Sequence
  Description of Artificial Sequence: Synthetic oligonucleotide
  Target: ATXN1; (+) strand; PAM type: YTN; PAM sequence: CTA
aatcaagacataattctcaa

SEQ ID NO: 310956 - DNA, 20 bp, Artificial Sequence
  Description of Artificial Sequence: Synthetic oligonucleotide
  Target: ATXN1; (+) strand; PAM type: YTN; PAM sequence: TTC
tcaattatcttttctttcaa

SEQ ID NO: 310957 - DNA, 20 bp, Artificial Sequence
  Description of Artificial Sequence: Synthetic oligonucleotide
  Target: ATXN1; (+) strand; PAM type: YTN; PAM sequence: CTC
aattatcttttctttcaaat

SEQ ID NO: 310958 - DNA, 20 bp, Artificial Sequence
  Description of Artificial Sequence: Synthetic oligonucleotide
  Target: ATXN1; (+) strand; PAM type: YTN; PAM sequence: TTA
tcttttctttcaaataccag

SEQ ID NO: 310959 - DNA, 20 bp, Artificial Sequence
  Description of Artificial Sequence: Synthetic oligonucleotide
  Target: ATXN1; (+) strand; PAM type: YTN; PAM sequence: CTT
ttctttcaaataccagggtt

SEQ ID NO: 310960 - DNA, 20 bp, Artificial Sequence
  Description of Artificial Sequence: Synthetic oligonucleotide
  Target: ATXN1; (+) strand; PAM type: YTN; PAM sequence: TTT
tctttcaaataccagggtta

SEQ ID NO: 310961 - DNA, 20 bp, Artificial Sequence
  Description of Artificial Sequence: Synthetic oligonucleotide
  Target: ATXN1; (+) strand; PAM type: YTN; PAM sequence: TTT
ctttcaaataccagggttat

SEQ ID NO: 310962 - DNA, 20 bp, Artificial Sequence
  Description of Artificial Sequence: Synthetic oligonucleotide
  Target: ATXN1; (+) strand; PAM type: YTN; PAM sequence: TTC
tttcaaataccagggttatg

SEQ ID NO: 310963 - DNA, 20 bp, Artificial Sequence
  Description of Artificial Sequence: Synthetic oligonucleotide
  Target: ATXN1; (+) strand; PAM type: YTN; PAM sequence: CTT
tcaaataccagggttatgaa

SEQ ID NO: 310964 - DNA, 20 bp, Artificial Sequence
  Description of Artificial Sequence: Synthetic oligonucleotide
  Target: ATXN1; (+) strand; PAM type: YTN; PAM sequence: TTT
caaataccagggttatgaaa

SEQ ID NO: 310965 - DNA, 20 bp, Artificial Sequence
  Description of Artificial Sequence: Synthetic oligonucleotide
  Target: ATXN1; (+) strand; PAM type: YTN; PAM sequence: TTC
aaataccagggttatgaaaa

SEQ ID NO: 310966 - DNA, 20 bp, Artificial Sequence
  Description of Artificial Sequence: Synthetic oligonucleotide
  Target: ATXN1; (+) strand; PAM type: YTN; PAM sequence: TTA
tgaaaatactcccccccgcc

SEQ ID NO: 310967 - DNA, 20 bp, Artificial Sequence
  Description of Artificial Sequence: Synthetic oligonucleotide
  Target: ATXN1; (+) strand; PAM type: YTN; PAM sequence: CTC
ccccccgcccgccccctgcc

SEQ ID NO: 310968 - DNA, 20 bp, Artificial Sequence
  Description of Artificial Sequence: Synthetic oligonucleotide
  Target: ATXN1; (+) strand; PAM type: YTN; PAM sequence: CTG
ccccacttagttggattgcc

SEQ ID NO: 310969 - DNA, 20 bp, Artificial Sequence
  Description of Artificial Sequence: Synthetic oligonucleotide
  Target: ATXN1; (+) strand; PAM type: YTN; PAM sequence: CTT
agttggattgcctgagcagc

SEQ ID NO: 310970 - DNA, 20 bp, Artificial Sequence
  Description of Artificial Sequence: Synthetic oligonucleotide
  Target: ATXN1; (+) strand; PAM type: YTN; PAM sequence: TTA
gttggattgcctgagcagca

SEQ ID NO: 310971 - DNA, 20 bp, Artificial Sequence
  Description of Artificial Sequence: Synthetic oligonucleotide
  Target: ATXN1; (+) strand; PAM type: YTN; PAM sequence: TTG
gattgcctgagcagcacaga

SEQ ID NO: 310972 - DNA, 20 bp, Artificial Sequence
  Description of Artificial Sequence: Synthetic oligonucleotide
  Target: ATXN1; (+) strand; PAM type: YTN; PAM sequence: TTG
cctgagcagcacagagcttc

SEQ ID NO: 310973 - DNA, 20 bp, Artificial Sequence
  Description of Artificial Sequence: Synthetic oligonucleotide
  Target: ATXN1; (+) strand; PAM type: YTN; PAM sequence: CTG
agcagcacagagcttcagca

SEQ ID NO: 310974 - DNA, 20 bp, Artificial Sequence
  Description of Artificial Sequence: Synthetic oligonucleotide
  Target: ATXN1; (+) strand; PAM type: YTN; PAM sequence: CTT
cagcaactaaagcaactttt

SEQ ID NO: 310975 - DNA, 20 bp, Artificial Sequence
  Description of Artificial Sequence: Synthetic oligonucleotide
  Target: ATXN1; (+) strand; PAM type: YTN; PAM sequence: TTC
agcaactaaagcaacttttc

SEQ ID NO: 310976 - DNA, 20 bp, Artificial Sequence
  Description of Artificial Sequence: Synthetic oligonucleotide
  Target: ATXN1; (+) strand; PAM type: YTN; PAM sequence: CTA
aagcaacttttccttttttc

SEQ ID NO: 310977 - DNA, 20 bp, Artificial Sequence
  Description of Artificial Sequence: Synthetic oligonucleotide
  Target: ATXN1; (+) strand; PAM type: YTN; PAM sequence: CTT
ttccttttttcctttttgcc

SEQ ID NO: 310978 - DNA, 20 bp, Artificial Sequence
  Description of Artificial Sequence: Synthetic oligonucleotide
  Target: ATXN1; (+) strand; PAM type: YTN; PAM sequence: TTT
tccttttttcctttttgcca

SEQ ID NO: 310979 - DNA, 20 bp, Artificial Sequence
  Description of Artificial Sequence: Synthetic oligonucleotide
  Target: ATXN1; (+) strand; PAM type: YTN; PAM sequence: TTT
ccttttttcctttttgccat

SEQ ID NO: 310980 - DNA, 20 bp, Artificial Sequence
  Description of Artificial Sequence: Synthetic oligonucleotide
  Target: ATXN1; (+) strand; PAM type: YTN; PAM sequence: TTC
cttttttcctttttgccata

SEQ ID NO: 310981 - DNA, 20 bp, Artificial Sequence
  Description of Artificial Sequence: Synthetic oligonucleotide
  Target: ATXN1; (+) strand; PAM type: YTN; PAM sequence: CTT
ttttcctttttgccataata

SEQ ID NO: 310982 - DNA, 20 bp, Artificial Sequence
  Description of Artificial Sequence: Synthetic oligonucleotide
  Target: ATXN1; (+) strand; PAM type: YTN; PAM sequence: TTT
tttcctttttgccataatat

SEQ ID NO: 310983 - DNA, 20 bp, Artificial Sequence
  Description of Artificial Sequence: Synthetic oligonucleotide
  Target: ATXN1; (+) strand; PAM type: YTN; PAM sequence: TTT
ttcctttttgccataatatt

SEQ ID NO: 310984 - DNA, 20 bp, Artificial Sequence
  Description of Artificial Sequence: Synthetic oligonucleotide
  Target: ATXN1; (+) strand; PAM type: YTN; PAM sequence: TTT
tcctttttgccataatatta

SEQ ID NO: 310985 - DNA, 20 bp, Artificial Sequence
  Description of Artificial Sequence: Synthetic oligonucleotide
  Target: ATXN1; (+) strand; PAM type: YTN; PAM sequence: TTT
cctttttgccataatattat

SEQ ID NO: 310986 - DNA, 20 bp, Artificial Sequence
  Description of Artificial Sequence: Synthetic oligonucleotide
  Target: ATXN1; (+) strand; PAM type: YTN; PAM sequence: TTC
ctttttgccataatattatt

SEQ ID NO: 310987 - DNA, 20 bp, Artificial Sequence
  Description of Artificial Sequence: Synthetic oligonucleotide
  Target: ATXN1; (+) strand; PAM type: YTN; PAM sequence: CTT
tttgccataatattatttct

SEQ ID NO: 310988 - DNA, 20 bp, Artificial Sequence
  Description of Artificial Sequence: Synthetic oligonucleotide
  Target: ATXN1; (+) strand; PAM type: YTN; PAM sequence: TTT
ttgccataatattatttctc

SEQ ID NO: 310989 - DNA, 20 bp, Artificial Sequence
  Description of Artificial Sequence: Synthetic oligonucleotide
  Target: ATXN1; (+) strand; PAM type: YTN; PAM sequence: TTT
tgccataatattatttctct

SEQ ID NO: 310990 - DNA, 20 bp, Artificial Sequence
  Description of Artificial Sequence: Synthetic oligonucleotide
  Target: ATXN1; (+) strand; PAM type: YTN; PAM sequence: TTT
gccataatattatttctctt

SEQ ID NO: 310991 - DNA, 20 bp, Artificial Sequence
  Description of Artificial Sequence: Synthetic oligonucleotide
  Target: ATXN1; (+) strand; PAM type: YTN; PAM sequence: TTG
ccataatattatttctcttt

SEQ ID NO: 310992 - DNA, 20 bp, Artificial Sequence
  Description of Artificial Sequence: Synthetic oligonucleotide
  Target: ATXN1; (+) strand; PAM type: YTN; PAM sequence: TTA
tttctctttgcttagccagc

SEQ ID NO: 310993 - DNA, 20 bp, Artificial Sequence
  Description of Artificial Sequence: Synthetic oligonucleotide
  Target: ATXN1; (+) strand; PAM type: YTN; PAM sequence: TTT
ctctttgcttagccagcttt

SEQ ID NO: 310994 - DNA, 20 bp, Artificial Sequence
  Description of Artificial Sequence: Synthetic oligonucleotide
  Target: ATXN1; (+) strand; PAM type: YTN; PAM sequence: TTC
tctttgcttagccagcttta

SEQ ID NO: 310995 - DNA, 20 bp, Artificial Sequence
  Description of Artificial Sequence: Synthetic oligonucleotide
  Target: ATXN1; (+) strand; PAM type: YTN; PAM sequence: CTC
tttgcttagccagctttatc

SEQ ID NO: 310996 - DNA, 20 bp, Artificial Sequence
  Description of Artificial Sequence: Synthetic oligonucleotide
  Target: ATXN1; (+) strand; PAM type: YTN; PAM sequence: CTT
tgcttagccagctttatcag

SEQ ID NO: 310997 - DNA, 20 bp, Artificial Sequence
  Description of Artificial Sequence: Synthetic oligonucleotide
  Target: ATXN1; (+) strand; PAM type: YTN; PAM sequence: TTT
gcttagccagctttatcagt

SEQ ID NO: 310998 - DNA, 20 bp, Artificial Sequence
  Description of Artificial Sequence: Synthetic oligonucleotide
  Target: ATXN1; (+) strand; PAM type: YTN; PAM sequence: TTG
cttagccagctttatcagtg

SEQ ID NO: 310999 - DNA, 20 bp, Artificial Sequence
  Description of Artificial Sequence: Synthetic oligonucleotide
  Target: ATXN1; (+) strand; PAM type: YTN; PAM sequence: CTT
agccagctttatcagtggtg

SEQ ID NO: 311000 - DNA, 20 bp, Artificial Sequence
  Description of Artificial Sequence: Synthetic oligonucleotide
  Target: ATXN1; (+) strand; PAM type: YTN; PAM sequence: TTA
gccagctttatcagtggtgc

SEQ ID NO: 311001 - DNA, 20 bp, Artificial Sequence
  Description of Artificial Sequence: Synthetic oligonucleotide
  Target: ATXN1; (+) strand; PAM type: YTN; PAM sequence: CTT
tatcagtggtgccctaatgc

SEQ ID NO: 311002 - DNA, 20 bp, Artificial Sequence
  Description of Artificial Sequence: Synthetic oligonucleotide
  Target: ATXN1; (+) strand; PAM type: YTN; PAM sequence: TTT
atcagtggtgccctaatgca

SEQ ID NO: 311003 - DNA, 20 bp, Artificial Sequence
  Description of Artificial Sequence: Synthetic oligonucleotide
  Target: ATXN1; (+) strand; PAM type: YTN; PAM sequence: TTA
tcagtggtgccctaatgcaa

SEQ ID NO: 311004 - DNA, 20 bp, Artificial Sequence
  Description of Artificial Sequence: Synthetic oligonucleotide
  Target: ATXN1; (+) strand; PAM type: YTN; PAM sequence: CTA
atgcaaagactagaatactg

SEQ ID NO: 311005 - DNA, 20 bp, Artificial Sequence
  Description of Artificial Sequence: Synthetic oligonucleotide
  Target: ATXN1; (+) strand; PAM type: YTN; PAM sequence: CTA
gaatactgctttctaactgc

SEQ ID NO: 311006 - DNA, 20 bp, Artificial Sequence
  Description of Artificial Sequence: Synthetic oligonucleotide
  Target: ATXN1; (+) strand; PAM type: YTN; PAM sequence: CTG
ctttctaactgctcactaaa

SEQ ID NO: 311007 - DNA, 20 bp, Artificial Sequence
  Description of Artificial Sequence: Synthetic oligonucleotide
  Target: ATXN1; (+) strand; PAM type: YTN; PAM sequence: CTT
tctaactgctcactaaatta

SEQ ID NO: 311008 - DNA, 20 bp, Artificial Sequence
  Description of Artificial Sequence: Synthetic oligonucleotide
  Target: ATXN1; (+) strand; PAM type: YTN; PAM sequence: TTT
ctaactgctcactaaattac

SEQ ID NO: 311009 - DNA, 20 bp, Artificial Sequence
  Description of Artificial Sequence: Synthetic oligonucleotide
  Target: ATXN1; (+) strand; PAM type: YTN; PAM sequence: TTC
taactgctcactaaattaca

SEQ ID NO: 311010 - DNA, 20 bp, Artificial Sequence
  Description of Artificial Sequence: Synthetic oligonucleotide
  Target: ATXN1; (+) strand; PAM type: YTN; PAM sequence: CTA
actgctcactaaattacatc

SEQ ID NO: 311011 - DNA, 20 bp, Artificial Sequence
  Description of Artificial Sequence: Synthetic oligonucleotide
  Target: ATXN1; (+) strand; PAM type: YTN; PAM sequence: CTG
ctcactaaattacatcctaa

SEQ ID NO: 311012 - DNA, 20 bp, Artificial Sequence
  Description of Artificial Sequence: Synthetic oligonucleotide
  Target: ATXN1; (+) strand; PAM type: YTN; PAM sequence: CTC
actaaattacatcctaaaat

SEQ ID NO: 311013 - DNA, 20 bp, Artificial Sequence
  Description of Artificial Sequence: Synthetic oligonucleotide
  Target: ATXN1; (+) strand; PAM type: YTN; PAM sequence: CTA
aattacatcctaaaataaag

SEQ ID NO: 311014 - DNA, 20 bp, Artificial Sequence
  Description of Artificial Sequence: Synthetic oligonucleotide
  Target: ATXN1; (+) strand; PAM type: YTN; PAM sequence: TTA
catcctaaaataaagtacat

SEQ ID NO: 311015 - DNA, 20 bp, Artificial Sequence
  Description of Artificial Sequence: Synthetic oligonucleotide
  Target: ATXN1; (+) strand; PAM type: YTN; PAM sequence: CTA
aaataaagtacatgtttatt

SEQ ID NO: 311016 - DNA, 20 bp, Artificial Sequence
  Description of Artificial Sequence: Synthetic oligonucleotide
  Target: ATXN1; (+) strand; PAM type: YTN; PAM sequence: TTT
attgtccaaaagcaccatgc

SEQ ID NO: 311017 - DNA, 20 bp, Artificial Sequence
  Description of Artificial Sequence: Synthetic oligonucleotide
  Target: ATXN1; (+) strand; PAM type: YTN; PAM sequence: TTA
ttgtccaaaagcaccatgca

SEQ ID NO: 311018 - DNA, 20 bp, Artificial Sequence
  Description of Artificial Sequence: Synthetic oligonucleotide
  Target: ATXN1; (+) strand; PAM type: YTN; PAM sequence: TTG
tccaaaagcaccatgcacta

SEQ ID NO: 311019 - DNA, 20 bp, Artificial Sequence
  Description of Artificial Sequence: Synthetic oligonucleotide
  Target: ATXN1; (+) strand; PAM type: YTN; PAM sequence: CTA
tcagtcctctagctataggc

SEQ ID NO: 311020 - DNA, 20 bp, Artificial Sequence
  Description of Artificial Sequence: Synthetic oligonucleotide
  Target: ATXN1; (+) strand; PAM type: YTN; PAM sequence: CTC
tagctataggcctctatcgt

SEQ ID NO: 311021 - DNA, 20 bp, Artificial Sequence
  Description of Artificial Sequence: Synthetic oligonucleotide
  Target: ATXN1; (+) strand; PAM type: YTN; PAM sequence: CTA
gctataggcctctatcgttt

SEQ ID NO: 311022 - DNA, 20 bp, Artificial Sequence
  Description of Artificial Sequence: Synthetic oligonucleotide
  Target: ATXN1; (+) strand; PAM type: YTN; PAM sequence: CTA
taggcctctatcgtttctcg

SEQ ID NO: 311023 - DNA, 20 bp, Artificial Sequence
  Description of Artificial Sequence: Synthetic oligonucleotide
  Target: ATXN1; (+) strand; PAM type: YTN; PAM sequence: CTC
tatcgtttctcgcttagcta

SEQ ID NO: 311024 - DNA, 20 bp, Artificial Sequence
  Description of Artificial Sequence: Synthetic oligonucleotide
  Target: ATXN1; (+) strand; PAM type: YTN; PAM sequence: CTA
tcgtttctcgcttagctaag

SEQ ID NO: 311025 - DNA, 20 bp, Artificial Sequence
  Description of Artificial Sequence: Synthetic oligonucleotide
  Target: ATXN1; (+) strand; PAM type: YTN; PAM sequence: TTT
ctcgcttagctaaggaaaaa

SEQ ID NO: 311026 - DNA, 20 bp, Artificial Sequence
  Description of Artificial Sequence: Synthetic oligonucleotide
  Target: ATXN1; (+) strand; PAM type: YTN; PAM sequence: TTC
tcgcttagctaaggaaaaaa

SEQ ID NO: 311027 - DNA, 20 bp, Artificial Sequence
  Description of Artificial Sequence: Synthetic oligonucleotide
  Target: ATXN1; (+) strand; PAM type: YTN; PAM sequence: CTC
gcttagctaaggaaaaaaaa

SEQ ID NO: 311028 - DNA, 20 bp, Artificial Sequence
  Description of Artificial Sequence: Synthetic oligonucleotide
  Target: ATXN1; (+) strand; PAM type: YTN; PAM sequence: CTT
agctaaggaaaaaaaaatcc

SEQ ID NO: 311029 - DNA, 20 bp, Artificial Sequence
  Description of Artificial Sequence: Synthetic oligonucleotide
  Target: ATXN1; (+) strand; PAM type: YTN; PAM sequence: TTA
gctaaggaaaaaaaaatcct

SEQ ID NO: 311030 - DNA, 20 bp, Artificial Sequence
  Description of Artificial Sequence: Synthetic oligonucleotide
  Target: ATXN1; (+) strand; PAM type: YTN; PAM sequence: CTA
aggaaaaaaaaatcctttta

SEQ ID NO: 311031 - DNA, 20 bp, Artificial Sequence
  Description of Artificial Sequence: Synthetic oligonucleotide
  Target: ATXN1; (+) strand; PAM type: YTN; PAM sequence: CTT
ttaacttactaccaaagatc

SEQ ID NO: 311032 - DNA, 20 bp, Artificial Sequence
  Description of Artificial Sequence: Synthetic oligonucleotide
  Target: ATXN1; (+) strand; PAM type: YTN; PAM sequence: TTT
taacttactaccaaagatca

SEQ ID NO: 311033 - DNA, 20 bp, Artificial Sequence
  Description of Artificial Sequence: Synthetic oligonucleotide
  Target: ATXN1; (+) strand; PAM type: YTN; PAM sequence: TTT
aacttactaccaaagatcat

SEQ ID NO: 311034 - DNA, 20 bp, Artificial Sequence
  Description of Artificial Sequence: Synthetic oligonucleotide
  Target: ATXN1; (+) strand; PAM type: YTN; PAM sequence: TTA
acttactaccaaagatcatt

SEQ ID NO: 311035 - DNA, 20 bp, Artificial Sequence
  Description of Artificial Sequence: Synthetic oligonucleotide
  Target: ATXN1; (+) strand; PAM type: YTN; PAM sequence: CTT
actaccaaagatcattcaaa

SEQ ID NO: 311036 - DNA, 20 bp, Artificial Sequence
  Description of Artificial Sequence: Synthetic oligonucleotide
  Target: ATXN1; (+) strand; PAM type: YTN; PAM sequence: TTA
ctaccaaagatcattcaaat

SEQ ID NO: 311037 - DNA, 20 bp, Artificial Sequence
  Description of Artificial Sequence: Synthetic oligonucleotide
  Target: ATXN1; (+) strand; PAM type: YTN; PAM sequence: CTA
ccaaagatcattcaaatcac

SEQ ID NO: 311038 - DNA, 20 bp, Artificial Sequence
  Description of Artificial Sequence: Synthetic oligonucleotide
  Target: ATXN1; (+) strand; PAM type: YTN; PAM sequence: TTC
aaatcacagccaatagatcc

SEQ ID NO: 311039 - DNA, 20 bp, Artificial Sequence
  Description of Artificial Sequence: Synthetic oligonucleotide
  Target: ATXN1; (+) strand; PAM type: YTN; PAM sequence: TTA
agaatgaatacattcagaat

SEQ ID NO: 311040 - DNA, 20 bp, Artificial Sequence
  Description of Artificial Sequence: Synthetic oligonucleotide
  Target: ATXN1; (+) strand; PAM type: YTN; PAM sequence: TTC
agaatgtctgcctactgtca

SEQ ID NO: 311041 - DNA, 20 bp, Artificial Sequence
  Description of Artificial Sequence: Synthetic oligonucleotide
  Target: ATXN1; (+) strand; PAM type: YTN; PAM sequence: CTG
cctactgtcagtaccagttt

SEQ ID NO: 311042 - DNA, 20 bp, Artificial Sequence
  Description of Artificial Sequence: Synthetic oligonucleotide
  Target: ATXN1; (+) strand; PAM type: YTN; PAM sequence: CTA
ctgtcagtaccagtttttgt

SEQ ID NO: 311043 - DNA, 20 bp, Artificial Sequence
  Description of Artificial Sequence: Synthetic oligonucleotide
  Target: ATXN1; (+) strand; PAM type: YTN; PAM sequence: CTG
tcagtaccagtttttgttat

SEQ ID NO: 311044 - DNA, 20 bp, Artificial Sequence
  Description of Artificial Sequence: Synthetic oligonucleotide
  Target: ATXN1; (+) strand; PAM type: YTN; PAM sequence: TTT
ttgttatgatggctgtcaag

SEQ ID NO: 311045 - DNA, 20 bp, Artificial Sequence
  Description of Artificial Sequence: Synthetic oligonucleotide
  Target: ATXN1; (+) strand; PAM type: YTN; PAM sequence: TTT
tgttatgatggctgtcaagt

SEQ ID NO: 311046 - DNA, 20 bp, Artificial Sequence
  Description of Artificial Sequence: Synthetic oligonucleotide
  Target: ATXN1; (+) strand; PAM type: YTN; PAM sequence: TTT
gttatgatggctgtcaagtt

SEQ ID NO: 311047 - DNA, 20 bp, Artificial Sequence
  Description of Artificial Sequence: Synthetic oligonucleotide
  Target: ATXN1; (+) strand; PAM type: YTN; PAM sequence: TTG
ttatgatggctgtcaagttt

SEQ ID NO: 311048 - DNA, 20 bp, Artificial Sequence
  Description of Artificial Sequence: Synthetic oligonucleotide
  Target: ATXN1; (+) strand; PAM type: YTN; PAM sequence: TTA
tgatggctgtcaagttttaa

SEQ ID NO: 311049 - DNA, 20 bp, Artificial Sequence
  Description of Artificial Sequence: Synthetic oligonucleotide
  Target: ATXN1; (+) strand; PAM type: YTN; PAM sequence: CTG
tcaagttttaaaatgtgaca

SEQ ID NO: 311050 - DNA, 20 bp, Artificial Sequence
  Description of Artificial Sequence: Synthetic oligonucleotide
  Target: ATXN1; (+) strand; PAM type: YTN; PAM sequence: TTT
taaaatgtgacaatgggaat

SEQ ID NO: 311051 - DNA, 20 bp, Artificial Sequence
  Description of Artificial Sequence: Synthetic oligonucleotide
  Target: ATXN1; (+) strand; PAM type: YTN; PAM sequence: TTT
aaaatgtgacaatgggaata

SEQ ID NO: 311052 - DNA, 20 bp, Artificial Sequence
  Description of Artificial Sequence: Synthetic oligonucleotide
  Target: ATXN1; (+) strand; PAM type: YTN; PAM sequence: TTA
aaatgtgacaatgggaatat

SEQ ID NO: 311053 - DNA, 20 bp, Artificial Sequence
  Description of Artificial Sequence: Synthetic oligonucleotide
  Target: ATXN1; (+) strand; PAM type: YTN; PAM sequence: TTT
tccgaataagttattcccct

SEQ ID NO: 311054 - DNA, 20 bp, Artificial Sequence
  Description of Artificial Sequence: Synthetic oligonucleotide
  Target: ATXN1; (+) strand; PAM type: YTN; PAM sequence: TTT
ccgaataagttattcccctg

SEQ ID NO: 311055 - DNA, 20 bp, Artificial Sequence
  Description of Artificial Sequence: Synthetic oligonucleotide
  Target: ATXN1; (+) strand; PAM type: YTN; PAM sequence: TTC
cgaataagttattcccctga

SEQ ID NO: 311056 - DNA, 20 bp, Artificial Sequence
  Description of Artificial Sequence: Synthetic oligonucleotide
  Target: ATXN1; (+) strand; PAM type: YTN; PAM sequence: TTA
ttcccctgagtaaacccttt

SEQ ID NO: 311057 - DNA, 20 bp, Artificial Sequence
  Description of Artificial Sequence: Synthetic oligonucleotide
  Target: ATXN1; (+) strand; PAM type: YTN; PAM sequence: TTC
ccctgagtaaaccctttaga

SEQ ID NO: 311058 - DNA, 20 bp, Artificial Sequence
  Description of Artificial Sequence: Synthetic oligonucleotide
  Target: ATXN1; (+) strand; PAM type: YTN; PAM sequence: CTG
agtaaaccctttagaaatcc

SEQ ID NO: 311059 - DNA, 20 bp, Artificial Sequence
  Description of Artificial Sequence: Synthetic oligonucleotide
  Target: ATXN1; (+) strand; PAM type: YTN; PAM sequence: CTT
tagaaatccagccatcgcta

SEQ ID NO: 311060 - DNA, 20 bp, Artificial Sequence
  Description of Artificial Sequence: Synthetic oligonucleotide
  Target: ATXN1; (+) strand; PAM type: YTN; PAM sequence: TTT
agaaatccagccatcgctat

SEQ ID NO: 311061 - DNA, 20 bp, Artificial Sequence
  Description of Artificial Sequence: Synthetic oligonucleotide
  Target: ATXN1; (+) strand; PAM type: YTN; PAM sequence: TTA
gaaatccagccatcgctatg

SEQ ID NO: 311062 - DNA, 20 bp, Artificial Sequence
  Description of Artificial Sequence: Synthetic oligonucleotide
  Target: ATXN1; (+) strand; PAM type: YTN; PAM sequence: CTA
tgggcaatggaggttccaaa

SEQ ID NO: 311063 - DNA, 20 bp, Artificial Sequence
  Description of Artificial Sequence: Synthetic oligonucleotide
  Target: ATXN1; (+) strand; PAM type: YTN; PAM sequence: TTC
caaatgatgaacgctcttca

SEQ ID NO: 311064 - DNA, 20 bp, Artificial Sequence
  Description of Artificial Sequence: Synthetic oligonucleotide
  Target: ATXN1; (+) strand; PAM type: YTN; PAM sequence: CTC
ttcacacttgaaagggttaa

SEQ ID NO: 311065 - DNA, 20 bp, Artificial Sequence
  Description of Artificial Sequence: Synthetic oligonucleotide
  Target: ATXN1; (+) strand; PAM type: YTN; PAM sequence: CTT
cacacttgaaagggttaagt

SEQ ID NO: 311066 - DNA, 20 bp, Artificial Sequence
  Description of Artificial Sequence: Synthetic oligonucleotide
  Target: ATXN1; (+) strand; PAM type: YTN; PAM sequence: TTC
acacttgaaagggttaagtg

SEQ ID NO: 311067 - DNA, 20 bp, Artificial Sequence
  Description of Artificial Sequence: Synthetic oligonucleotide
  Target: ATXN1; (+) strand; PAM type: YTN; PAM sequence: CTT
gaaagggttaagtgactgac

SEQ ID NO: 311068 - DNA, 20 bp, Artificial Sequence
  Description of Artificial Sequence: Synthetic oligonucleotide
  Target: ATXN1; (+) strand; PAM type: YTN; PAM sequence: TTG
aaagggttaagtgactgact

SEQ ID NO: 311069 - DNA, 20 bp, Artificial Sequence
  Description of Artificial Sequence: Synthetic oligonucleotide
  Target: ATXN1; (+) strand; PAM type: YTN; PAM sequence: TTA
agtgactgactgcaaggcca

SEQ ID NO: 311070 - DNA, 20 bp, Artificial Sequence
  Description of Artificial Sequence: Synthetic oligonucleotide
  Target: ATXN1; (+) strand; PAM type: YTN; PAM sequence: CTG
actgcaaggccaaaggcacc

SEQ ID NO: 311071 - DNA, 20 bp, Artificial Sequence
  Description of Artificial Sequence: Synthetic oligonucleotide
  Target: ATXN1; (+) strand; PAM type: YTN; PAM sequence: CTG
caaggccaaaggcaccagac

SEQ ID NO: 311072 - DNA, 20 bp, Artificial Sequence
  Description of Artificial Sequence: Synthetic oligonucleotide
  Target: ATXN1; (+) strand; PAM type: YTN; PAM sequence: CTG
caaaagaaatgttgctttag

SEQ ID NO: 311073 - DNA, 20 bp, Artificial Sequence
  Description of Artificial Sequence: Synthetic oligonucleotide
  Target: ATXN1; (+) strand; PAM type: YTN; PAM sequence: TTG
ctttagtgagctctgaaagg

SEQ ID NO: 311074 - DNA, 20 bp, Artificial Sequence
  Description of Artificial Sequence: Synthetic oligonucleotide
  Target: ATXN1; (+) strand; PAM type: YTN; PAM sequence: CTT
tagtgagctctgaaaggttt

SEQ ID NO: 311075 - DNA, 20 bp, Artificial Sequence
  Description of Artificial Sequence: Synthetic oligonucleotide
  Target: ATXN1; (+) strand; PAM type: YTN; PAM sequence: TTT
agtgagctctgaaaggtttc

SEQ ID NO: 311076 - DNA, 20 bp, Artificial Sequence
  Description of Artificial Sequence: Synthetic oligonucleotide
  Target: ATXN1; (+) strand; PAM type: YTN; PAM sequence: TTA
gtgagctctgaaaggtttct

SEQ ID NO: 311077 - DNA, 20 bp, Artificial Sequence
  Description of Artificial Sequence: Synthetic oligonucleotide
  Target: ATXN1; (+) strand; PAM type: YTN; PAM sequence: CTC
tgaaaggtttctaacaagta

SEQ ID NO: 311078 - DNA, 20 bp, Artificial Sequence
  Description of Artificial Sequence: Synthetic oligonucleotide
  Target: ATXN1; (+) strand; PAM type: YTN; PAM sequence: CTG
aaaggtttctaacaagtacc

SEQ ID NO: 311079 - DNA, 20 bp, Artificial Sequence
  Description of Artificial Sequence: Synthetic oligonucleotide
  Target: ATXN1; (+) strand; PAM type: YTN; PAM sequence: TTT
ctaacaagtaccaaatactt

SEQ ID NO: 311080 - DNA, 20 bp, Artificial Sequence
  Description of Artificial Sequence: Synthetic oligonucleotide
  Target: ATXN1; (+) strand; PAM type: YTN; PAM sequence: TTC
taacaagtaccaaatacttg

SEQ ID NO: 311081 - DNA, 20 bp, Artificial Sequence
  Description of Artificial Sequence: Synthetic oligonucleotide
  Target: ATXN1; (+) strand; PAM type: YTN; PAM sequence: CTA
acaagtaccaaatacttgtt

SEQ ID NO: 311082 - DNA, 20 bp, Artificial Sequence
  Description of Artificial Sequence: Synthetic oligonucleotide
  Target: ATXN1; (+) strand; PAM type: YTN; PAM sequence: CTT
gttgatctgttcacaataaa

SEQ ID NO: 311083 - DNA, 20 bp, Artificial Sequence
  Description of Artificial Sequence: Synthetic oligonucleotide
  Target: ATXN1; (+) strand; PAM type: YTN; PAM sequence: TTG
ttgatctgttcacaataaac

SEQ ID NO: 311084 - DNA, 20 bp, Artificial Sequence
  Description of Artificial Sequence: Synthetic oligonucleotide
  Target: ATXN1; (+) strand; PAM type: YTN; PAM sequence: TTG
atctgttcacaataaacacc

SEQ ID NO: 311085 - DNA, 20 bp, Artificial Sequence
  Description of Artificial Sequence: Synthetic oligonucleotide
  Target: ATXN1; (+) strand; PAM type: YTN; PAM sequence: CTG
ttcacaataaacaccagcag

SEQ ID NO: 311086 - DNA, 20 bp, Artificial Sequence
  Description of Artificial Sequence: Synthetic oligonucleotide
  Target: ATXN1; (+) strand; PAM type: YTN; PAM sequence: TTC
acaataaacaccagcaggat

SEQ ID NO: 311087 - DNA, 20 bp, Artificial Sequence
  Description of Artificial Sequence: Synthetic oligonucleotide
  Target: ATXN1; (+) strand; PAM type: YTN; PAM sequence: TTG
tcaggctcctttcactgtct

SEQ ID NO: 311088 - DNA, 20 bp, Artificial Sequence
  Description of Artificial Sequence: Synthetic oligonucleotide
  Target: ATXN1; (+) strand; PAM type: YTN; PAM sequence: CTC
ctttcactgtctggggagat

SEQ ID NO: 311089 - DNA, 20 bp, Artificial Sequence
  Description of Artificial Sequence: Synthetic oligonucleotide
  Target: ATXN1; (+) strand; PAM type: YTN; PAM sequence: CTT
tcactgtctggggagatgca

SEQ ID NO: 311090 - DNA, 20 bp, Artificial Sequence
  Description of Artificial Sequence: Synthetic oligonucleotide
  Target: ATXN1; (+) strand; PAM type: YTN; PAM sequence: TTT
cactgtctggggagatgcat

SEQ ID NO: 311091 - DNA, 20 bp, Artificial Sequence
  Description of Artificial Sequence: Synthetic oligonucleotide
  Target: ATXN1; (+) strand; PAM type: YTN; PAM sequence: TTC
actgtctggggagatgcatt

SEQ ID NO: 311092 - DNA, 20 bp, Artificial Sequence
  Description of Artificial Sequence: Synthetic oligonucleotide
  Target: ATXN1; (+) strand; PAM type: YTN; PAM sequence: CTG
tctggggagatgcatttaca

SEQ ID NO: 311093 - DNA, 20 bp, Artificial Sequence
  Description of Artificial Sequence: Synthetic oligonucleotide
  Target: ATXN1; (+) strand; PAM type: YTN; PAM sequence: CTG
gggagatgcatttacatact

SEQ ID NO: 311094 - DNA, 20 bp, Artificial Sequence
  Description of Artificial Sequence: Synthetic oligonucleotide
  Target: ATXN1; (+) strand; PAM type: YTN; PAM sequence: TTT
acatactgcacctaggaaga

SEQ ID NO: 311095 - DNA, 20 bp, Artificial Sequence
  Description of Artificial Sequence: Synthetic oligonucleotide
  Target: ATXN1; (+) strand; PAM type: YTN; PAM sequence: TTA
catactgcacctaggaagaa

SEQ ID NO: 311096 - DNA, 20 bp, Artificial Sequence
  Description of Artificial Sequence: Synthetic oligonucleotide
  Target: ATXN1; (+) strand; PAM type: YTN; PAM sequence: CTG
cacctaggaagaacagcttg

SEQ ID NO: 311097 - DNA, 20 bp, Artificial Sequence
  Description of Artificial Sequence: Synthetic oligonucleotide
  Target: ATXN1; (+) strand; PAM type: YTN; PAM sequence: CTA
ggaagaacagcttgttggtc

SEQ ID NO: 311098 - DNA, 20 bp, Artificial Sequence
  Description of Artificial Sequence: Synthetic oligonucleotide
  Target: ATXN1; (+) strand; PAM type: YTN; PAM sequence: CTT
gttggtctcctttataaaag

SEQ ID NO: 311099 - DNA, 20 bp, Artificial Sequence
  Description of Artificial Sequence: Synthetic oligonucleotide
  Target: ATXN1; (+) strand; PAM type: YTN; PAM sequence: TTG
ttggtctcctttataaaagt

SEQ ID NO: 311100 - DNA, 20 bp, Artificial Sequence
  Description of Artificial Sequence: Synthetic oligonucleotide
  Target: ATXN1; (+) strand; PAM type: YTN; PAM sequence: TTG
gtctcctttataaaagttga

SEQ ID NO: 311101 - DNA, 20 bp, Artificial Sequence
  Description of Artificial Sequence: Synthetic oligonucleotide
  Target: ATXN1; (+) strand; PAM type: YTN; PAM sequence: CTC
ctttataaaagttgagtagc

SEQ ID NO: 311102 - DNA, 20 bp, Artificial Sequence
  Description of Artificial Sequence: Synthetic oligonucleotide
  Target: ATXN1; (+) strand; PAM type: YTN; PAM sequence: CTT
tataaaagttgagtagctag

SEQ ID NO: 311103 - DNA, 20 bp, Artificial Sequence
  Description of Artificial Sequence: Synthetic oligonucleotide
  Target: ATXN1; (+) strand; PAM type: YTN; PAM sequence: TTT
ataaaagttgagtagctaga

SEQ ID NO: 311104 - DNA, 20 bp, Artificial Sequence
  Description of Artificial Sequence: Synthetic oligonucleotide
  Target: ATXN1; (+) strand; PAM type: YTN; PAM sequence: TTA
taaaagttgagtagctagaa

SEQ ID NO: 311105 - DNA, 20 bp, Artificial Sequence
  Description of Artificial Sequence: Synthetic oligonucleotide
  Target: ATXN1; (+) strand; PAM type: YTN; PAM sequence: TTG
agtagctagaagcctcattc

SEQ ID NO: 311106 - DNA, 20 bp, Artificial Sequence
  Description of Artificial Sequence: Synthetic oligonucleotide
  Target: ATXN1; (+) strand; PAM type: YTN; PAM sequence: CTA
gaagcctcattcagtgtctc

SEQ ID NO: 311107 - DNA, 20 bp, Artificial Sequence
  Description of Artificial Sequence: Synthetic oligonucleotide
  Target: ATXN1; (+) strand; PAM type: YTN; PAM sequence: CTC
attcagtgtctcccatccaa

SEQ ID NO: 311108 - DNA, 20 bp, Artificial Sequence
  Description of Artificial Sequence: Synthetic oligonucleotide
  Target: ATXN1; (+) strand; PAM type: YTN; PAM sequence: TTC
agtgtctcccatccaaatga

SEQ ID NO: 311109 - DNA, 20 bp, Artificial Sequence
  Description of Artificial Sequence: Synthetic oligonucleotide
  Target: ATXN1; (+) strand; PAM type: YTN; PAM sequence: CTC
ccatccaaatgactgaaaga

SEQ ID NO: 311110 - DNA, 20 bp, Artificial Sequence
  Description of Artificial Sequence: Synthetic oligonucleotide
  Target: ATXN1; (+) strand; PAM type: YTN; PAM sequence: CTG
aaagaagatgcaattgaaat

SEQ ID NO: 311111 - DNA, 20 bp, Artificial Sequence
  Description of Artificial Sequence: Synthetic oligonucleotide
  Target: ATXN1; (+) strand; PAM type: YTN; PAM sequence: TTG
aaatagtggagtctctcgtc

SEQ ID NO: 311112 - DNA, 20 bp, Artificial Sequence
  Description of Artificial Sequence: Synthetic oligonucleotide
  Target: ATXN1; (+) strand; PAM type: YTN; PAM sequence: CTC
tcgtctggcttgggcagcat

SEQ ID NO: 311113 - DNA, 20 bp, Artificial Sequence
  Description of Artificial Sequence: Synthetic oligonucleotide
  Target: ATXN1; (+) strand; PAM type: YTN; PAM sequence: CTC
gtctggcttgggcagcataa

SEQ ID NO: 311114 - DNA, 20 bp, Artificial Sequence
  Description of Artificial Sequence: Synthetic oligonucleotide
  Target: ATXN1; (+) strand; PAM type: YTN; PAM sequence: CTG
gcttgggcagcataaatgct

SEQ ID NO: 311115 - DNA, 20 bp, Artificial Sequence
  Description of Artificial Sequence: Synthetic oligonucleotide
  Target: ATXN1; (+) strand; PAM type: YTN; PAM sequence: CTT
gggcagcataaatgctgtgc

SEQ ID NO: 311116 - DNA, 20 bp, Artificial Sequence
  Description of Artificial Sequence: Synthetic oligonucleotide
  Target: ATXN1; (+) strand; PAM type: YTN; PAM sequence: TTG
ggcagcataaatgctgtgca

SEQ ID NO: 311117 - DNA, 20 bp, Artificial Sequence
  Description of Artificial Sequence: Synthetic oligonucleotide
  Target: ATXN1; (+) strand; PAM type: YTN; PAM sequence: CTG
tgcataaaacacttggagta

SEQ ID NO: 311118 - DNA, 20 bp, Artificial Sequence
  Description of Artificial Sequence: Synthetic oligonucleotide
  Target: ATXN1; (+) strand; PAM type: YTN; PAM sequence: CTT
ggagtagttcaggcacaaga

SEQ ID NO: 311119 - DNA, 20 bp, Artificial Sequence
  Description of Artificial Sequence: Synthetic oligonucleotide
  Target: ATXN1; (+) strand; PAM type: YTN; PAM sequence: TTG
gagtagttcaggcacaagac

SEQ ID NO: 311120 - DNA, 20 bp, Artificial Sequence
  Description of Artificial Sequence: Synthetic oligonucleotide
  Target: ATXN1; (+) strand; PAM type: YTN; PAM sequence: TTC
aggcacaagacaaacccacc

SEQ ID NO: 311121 - DNA, 20 bp, Artificial Sequence
  Description of Artificial Sequence: Synthetic oligonucleotide
  Target: ATXN1; (+) strand; PAM type: YTN; PAM sequence: CTG
aatggacgaggaacactgtc

SEQ ID NO: 311122 - DNA, 20 bp, Artificial Sequence
  Description of Artificial Sequence: Synthetic oligonucleotide
  Target: ATXN1; (+) strand; PAM type: YTN; PAM sequence: CTG
tctgttgccatggcagcctg

SEQ ID NO: 311123 - DNA, 20 bp, Artificial Sequence
  Description of Artificial Sequence: Synthetic oligonucleotide
  Target: ATXN1; (+) strand; PAM type: YTN; PAM sequence: CTG
ttgccatggcagcctgatct

SEQ ID NO: 311124 - DNA, 20 bp, Artificial Sequence
  Description of Artificial Sequence: Synthetic oligonucleotide
  Target: ATXN1; (+) strand; PAM type: YTN; PAM sequence: TTG
ccatggcagcctgatctaat

SEQ ID NO: 311125 - DNA, 20 bp, Artificial Sequence
  Description of Artificial Sequence: Synthetic oligonucleotide
  Target: ATXN1; (+) strand; PAM type: YTN; PAM sequence: CTG
atctaattacatgagtgatc

SEQ ID NO: 311126 - DNA, 20 bp, Artificial Sequence
  Description of Artificial Sequence: Synthetic oligonucleotide
  Target: ATXN1; (+) strand; PAM type: YTN; PAM sequence: CTA
attacatgagtgatcaggac

SEQ ID NO: 311127 - DNA, 20 bp, Artificial Sequence
  Description of Artificial Sequence: Synthetic oligonucleotide
  Target: ATXN1; (+) strand; PAM type: YTN; PAM sequence: TTA
catgagtgatcaggactgga

SEQ ID NO: 311128 - DNA, 20 bp, Artificial Sequence
  Description of Artificial Sequence: Synthetic oligonucleotide
  Target: ATXN1; (+) strand; PAM type: YTN; PAM sequence: CTG
gagtaagtgcaccgaaaacc

SEQ ID NO: 311129 - DNA, 20 bp, Artificial Sequence
  Description of Artificial Sequence: Synthetic oligonucleotide
  Target: ATXN1; (+) strand; PAM type: YTN; PAM sequence: CTA
caccactgacaggcagccag

SEQ ID NO: 311130 - DNA, 20 bp, Artificial Sequence
  Description of Artificial Sequence: Synthetic oligonucleotide
  Target: ATXN1; (+) strand; PAM type: YTN; PAM sequence: CTG
acaggcagccaggaggttca

SEQ ID NO: 311131 - DNA, 20 bp, Artificial Sequence
  Description of Artificial Sequence: Synthetic oligonucleotide
  Target: ATXN1; (+) strand; PAM type: YTN; PAM sequence: TTC
aggggagcccttcaacctct

SEQ ID NO: 311132 - DNA, 20 bp, Artificial Sequence
  Description of Artificial Sequence: Synthetic oligonucleotide
  Target: ATXN1; (+) strand; PAM type: YTN; PAM sequence: CTT
caacctctgctttatgtaga

SEQ ID NO: 311133 - DNA, 20 bp, Artificial Sequence
  Description of Artificial Sequence: Synthetic oligonucleotide
  Target: ATXN1; (+) strand; PAM type: YTN; PAM sequence: TTC
aacctctgctttatgtagaa

SEQ ID NO: 311134 - DNA, 20 bp, Artificial Sequence
  Description of Artificial Sequence: Synthetic oligonucleotide
  Target: ATXN1; (+) strand; PAM type: YTN; PAM sequence: CTC
tgctttatgtagaagatggc

SEQ ID NO: 311135 - DNA, 20 bp, Artificial Sequence
  Description of Artificial Sequence: Synthetic oligonucleotide
  Target: ATXN1; (+) strand; PAM type: YTN; PAM sequence: CTG
ctttatgtagaagatggcat

SEQ ID NO: 311136 - DNA, 20 bp, Artificial Sequence
  Description of Artificial Sequence: Synthetic oligonucleotide
  Target: ATXN1; (+) strand; PAM type: YTN; PAM sequence: CTT
tatgtagaagatggcattca

SEQ ID NO: 311137 - DNA, 20 bp, Artificial Sequence
  Description of Artificial Sequence: Synthetic oligonucleotide
  Target: ATXN1; (+) strand; PAM type: YTN; PAM sequence: TTT
atgtagaagatggcattcaa

SEQ ID NO: 311138 - DNA, 20 bp, Artificial Sequence
  Description of Artificial Sequence: Synthetic oligonucleotide
  Target: ATXN1; (+) strand; PAM type: YTN; PAM sequence: TTA
tgtagaagatggcattcaag

SEQ ID NO: 311139 - DNA, 20 bp, Artificial Sequence
  Description of Artificial Sequence: Synthetic oligonucleotide
  Target: ATXN1; (+) strand; PAM type: YTN; PAM sequence: TTC
aagtccatttatttgcggag

SEQ ID NO: 311140 - DNA, 20 bp, Artificial Sequence
  Description of Artificial Sequence: Synthetic oligonucleotide
  Target: ATXN1; (+) strand; PAM type: YTN; PAM sequence: TTT
atttgcggagctgctaaaat

SEQ ID NO: 311141 - DNA, 20 bp, Artificial Sequence
  Description of Artificial Sequence: Synthetic oligonucleotide
  Target: ATXN1; (+) strand; PAM type: YTN; PAM sequence: TTA
tttgcggagctgctaaaata

SEQ ID NO: 311142 - DNA, 20 bp, Artificial Sequence
  Description of Artificial Sequence: Synthetic oligonucleotide
  Target: ATXN1; (+) strand; PAM type: YTN; PAM sequence: TTT
gcggagctgctaaaatattg

SEQ ID NO: 311143 - DNA, 20 bp, Artificial Sequence
  Description of Artificial Sequence: Synthetic oligonucleotide
  Target: ATXN1; (+) strand; PAM type: YTN; PAM sequence: TTG
cggagctgctaaaatattga

SEQ ID NO: 311144 - DNA, 20 bp, Artificial Sequence
  Description of Artificial Sequence: Synthetic oligonucleotide
  Target: ATXN1; (+) strand; PAM type: YTN; PAM sequence: CTG
ctaaaatattgactgatgca

SEQ ID NO: 311145 - DNA, 20 bp, Artificial Sequence
  Description of Artificial Sequence: Synthetic oligonucleotide
  Target: ATXN1; (+) strand; PAM type: YTN; PAM sequence: CTA
aaatattgactgatgcatgc

SEQ ID NO: 311146 - DNA, 20 bp, Artificial Sequence
  Description of Artificial Sequence: Synthetic oligonucleotide
  Target: ATXN1; (+) strand; PAM type: YTN; PAM sequence: TTG
actgatgcatgcacagtgag

SEQ ID NO: 311147 - DNA, 20 bp, Artificial Sequence
  Description of Artificial Sequence: Synthetic oligonucleotide
  Target: ATXN1; (+) strand; PAM type: YTN; PAM sequence: CTG
atgcatgcacagtgagaggg

SEQ ID NO: 311148 - DNA, 20 bp, Artificial Sequence
  Description of Artificial Sequence: Synthetic oligonucleotide
  Target: ATXN1; (+) strand; PAM type: YTN; PAM sequence: TTA
aatgccacagcgctagccgt

SEQ ID NO: 311149 - DNA, 20 bp, Artificial Sequence
  Description of Artificial Sequence: Synthetic oligonucleotide
  Target: ATXN1; (+) strand; PAM type: YTN; PAM sequence: CTA
gccgttatggtgcaatccct

SEQ ID NO: 311150 - DNA, 20 bp, Artificial Sequence
  Description of Artificial Sequence: Synthetic oligonucleotide
  Target: ATXN1; (+) strand; PAM type: YTN; PAM sequence: TTA
tggtgcaatccctttccaag

SEQ ID NO: 311151 - DNA, 20 bp, Artificial Sequence
  Description of Artificial Sequence: Synthetic oligonucleotide
  Target: ATXN1; (+) strand; PAM type: YTN; PAM sequence: CTT
tccaagagttcctgtgcagg

SEQ ID NO: 311152 - DNA, 20 bp, Artificial Sequence
  Description of Artificial Sequence: Synthetic oligonucleotide
  Target: ATXN1; (+) strand; PAM type: YTN; PAM sequence: TTT
ccaagagttcctgtgcagga

SEQ ID NO: 311153 - DNA, 20 bp, Artificial Sequence
  Description of Artificial Sequence: Synthetic oligonucleotide
  Target: ATXN1; (+) strand; PAM type: YTN; PAM sequence: TTC
caagagttcctgtgcaggat

SEQ ID NO: 311154 - DNA, 20 bp, Artificial Sequence
  Description of Artificial Sequence: Synthetic oligonucleotide
  Target: ATXN1; (+) strand; PAM type: YTN; PAM sequence: TTC
ctgtgcaggattttctcttc

SEQ ID NO: 311155 - DNA, 20 bp, Artificial Sequence
  Description of Artificial Sequence: Synthetic oligonucleotide
  Target: ATXN1; (+) strand; PAM type: YTN; PAM sequence: CTG
tgcaggattttctcttctct

SEQ ID NO: 311156 - DNA, 20 bp, Artificial Sequence
  Description of Artificial Sequence: Synthetic oligonucleotide
  Target: ATXN1; (+) strand; PAM type: YTN; PAM sequence: TTT
tctcttctctctggtggttt

SEQ ID NO: 311157 - DNA, 20 bp, Artificial Sequence
  Description of Artificial Sequence: Synthetic oligonucleotide
  Target: ATXN1; (+) strand; PAM type: YTN; PAM sequence: TTT
ctcttctctctggtggtttc

SEQ ID NO: 311158 - DNA, 20 bp, Artificial Sequence
  Description of Artificial Sequence: Synthetic oligonucleotide
  Target: ATXN1; (+) strand; PAM type: YTN; PAM sequence: TTC
tcttctctctggtggtttcc

SEQ ID NO: 311159 - DNA, 20 bp, Artificial Sequence
  Description of Artificial Sequence: Synthetic oligonucleotide
  Target: ATXN1; (+) strand; PAM type: YTN; PAM sequence: CTC
ttctctctggtggtttcctc

SEQ ID NO: 311160 - DNA, 20 bp, Artificial Sequence
  Description of Artificial Sequence: Synthetic oligonucleotide
  Target: ATXN1; (+) strand; PAM type: YTN; PAM sequence: CTT
ctctctggtggtttcctcag

SEQ ID NO: 311161 - DNA, 20 bp, Artificial Sequence
  Description of Artificial Sequence: Synthetic oligonucleotide
  Target: ATXN1; (+) strand; PAM type: YTN; PAM sequence: TTC
tctctggtggtttcctcaga

SEQ ID NO: 311162 - DNA, 20 bp, Artificial Sequence
  Description of Artificial Sequence: Synthetic oligonucleotide
  Target: ATXN1; (+) strand; PAM type: YTN; PAM sequence: CTC
tctggtggtttcctcagaca

SEQ ID NO: 311163 - DNA, 20 bp, Artificial Sequence
  Description of Artificial Sequence: Synthetic oligonucleotide
  Target: ATXN1; (+) strand; PAM type: YTN; PAM sequence: CTC
tggtggtttcctcagacata

SEQ ID NO: 311164 - DNA, 20 bp, Artificial Sequence
  Description of Artificial Sequence: Synthetic oligonucleotide
  Target: ATXN1; (+) strand; PAM type: YTN; PAM sequence: CTG
gtggtttcctcagacataag

SEQ ID NO: 311165 - DNA, 20 bp, Artificial Sequence
  Description of Artificial Sequence: Synthetic oligonucleotide
  Target: ATXN1; (+) strand; PAM type: YTN; PAM sequence: TTT
cctcagacataagcttcact

SEQ ID NO: 311166 - DNA, 20 bp, Artificial Sequence
  Description of Artificial Sequence: Synthetic oligonucleotide
  Target: ATXN1; (+) strand; PAM type: YTN; PAM sequence: TTC
ctcagacataagcttcactc

SEQ ID NO: 311167 - DNA, 20 bp, Artificial Sequence
  Description of Artificial Sequence: Synthetic oligonucleotide
  Target: ATXN1; (+) strand; PAM type: YTN; PAM sequence: CTC
agacataagcttcactccaa

SEQ ID NO: 311168 - DNA, 20 bp, Artificial Sequence
  Description of Artificial Sequence: Synthetic oligonucleotide
  Target: ATXN1; (+) strand; PAM type: YTN; PAM sequence: CTT
cactccaaaaaaagctcaag

SEQ ID NO: 311169 - DNA, 20 bp, Artificial Sequence
  Description of Artificial Sequence: Synthetic oligonucleotide
  Target: ATXN1; (+) strand; PAM type: YTN; PAM sequence: TTC
actccaaaaaaagctcaagt

SEQ ID NO: 311170 - DNA, 20 bp, Artificial Sequence
  Description of Artificial Sequence: Synthetic oligonucleotide
  Target: ATXN1; (+) strand; PAM type: YTN; PAM sequence: CTC
caaaaaaagctcaagtatca

SEQ ID NO: 311171 - DNA, 20 bp, Artificial Sequence
  Description of Artificial Sequence: Synthetic oligonucleotide
  Target: ATXN1; (+) strand; PAM type: YTN; PAM sequence: CTC
aagtatcaaactacctttac

SEQ ID NO: 311172 - DNA, 20 bp, Artificial Sequence
  Description of Artificial Sequence: Synthetic oligonucleotide
  Target: ATXN1; (+) strand; PAM type: YTN; PAM sequence: CTA
cctttacccatcaaataaac

SEQ ID NO: 311173 - DNA, 20 bp, Artificial Sequence
  Description of Artificial Sequence: Synthetic oligonucleotide
  Target: ATXN1; (+) strand; PAM type: YTN; PAM sequence: CTT
tacccatcaaataaaccgaa

SEQ ID NO: 311174 - DNA, 20 bp, Artificial Sequence
  Description of Artificial Sequence: Synthetic oligonucleotide
  Target: ATXN1; (+) strand; PAM type: YTN; PAM sequence: TTT
acccatcaaataaaccgaag

SEQ ID NO: 311175 - DNA, 20 bp, Artificial Sequence
  Description of Artificial Sequence: Synthetic oligonucleotide
  Target: ATXN1; (+) strand; PAM type: YTN; PAM sequence: TTA
cccatcaaataaaccgaagg

SEQ ID NO: 311176 - DNA, 20 bp, Artificial Sequence
  Description of Artificial Sequence: Synthetic oligonucleotide
  Target: ATXN1; (+) strand; PAM type: YTN; PAM sequence: CTT
aaggggggcttctaggaact

SEQ ID NO: 311177 - DNA, 20 bp, Artificial Sequence
  Description of Artificial Sequence: Synthetic oligonucleotide
  Target: ATXN1; (+) strand; PAM type: YTN; PAM sequence: TTA
aggggggcttctaggaactg

SEQ ID NO: 311178 - DNA, 20 bp, Artificial Sequence
  Description of Artificial Sequence: Synthetic oligonucleotide
  Target: ATXN1; (+) strand; PAM type: YTN; PAM sequence: CTT
ctaggaactgcagcctccta

SEQ ID NO: 311179 - DNA, 20 bp, Artificial Sequence
  Description of Artificial Sequence: Synthetic oligonucleotide
  Target: ATXN1; (+) strand; PAM type: YTN; PAM sequence: TTC
taggaactgcagcctcctaa

SEQ ID NO: 311180 - DNA, 20 bp, Artificial Sequence
  Description of Artificial Sequence: Synthetic oligonucleotide
  Target: ATXN1; (+) strand; PAM type: YTN; PAM sequence: CTA
ggaactgcagcctcctaaaa

SEQ ID NO: 311181 - DNA, 20 bp, Artificial Sequence
  Description of Artificial Sequence: Synthetic oligonucleotide
  Target: ATXN1; (+) strand; PAM type: YTN; PAM sequence: CTG
cagcctcctaaaaaacccaa

SEQ ID NO: 311182 - DNA, 20 bp, Artificial Sequence
  Description of Artificial Sequence: Synthetic oligonucleotide
  Target: ATXN1; (+) strand; PAM type: YTN; PAM sequence: CTC
ctaaaaaacccaaacagaaa

SEQ ID NO: 311183 - DNA, 20 bp, Artificial Sequence
  Description of Artificial Sequence: Synthetic oligonucleotide
  Target: ATXN1; (+) strand; PAM type: YTN; PAM sequence: CTA
aaaaacccaaacagaaatgt

SEQ ID NO: 311184 - DNA, 20 bp, Artificial Sequence
  Description of Artificial Sequence: Synthetic oligonucleotide
  Target: ATXN1; (+) strand; PAM type: YTN; PAM sequence: CTC
agctaacactgttgaaaaag

SEQ ID NO: 311185 - DNA, 20 bp, Artificial Sequence
  Description of Artificial Sequence: Synthetic oligonucleotide
  Target: ATXN1; (+) strand; PAM type: YTN; PAM sequence: CTA
acactgttgaaaaagtaact

SEQ ID NO: 311186 - DNA, 20 bp, Artificial Sequence
  Description of Artificial Sequence: Synthetic oligonucleotide
  Target: ATXN1; (+) strand; PAM type: YTN; PAM sequence: CTG
ttgaaaaagtaactagctgt

SEQ ID NO: 311187 - DNA, 20 bp, Artificial Sequence
  Description of Artificial Sequence: Synthetic oligonucleotide
  Target: ATXN1; (+) strand; PAM type: YTN; PAM sequence: TTG
aaaaagtaactagctgtgcc

SEQ ID NO: 311188 - DNA, 20 bp, Artificial Sequence
  Description of Artificial Sequence: Synthetic oligonucleotide
  Target: ATXN1; (+) strand; PAM type: YTN; PAM sequence: CTA
gctgtgcctaaaaataacca

SEQ ID NO: 311189 - DNA, 20 bp, Artificial Sequence
  Description of Artificial Sequence: Synthetic oligonucleotide
  Target: ATXN1; (+) strand; PAM type: YTN; PAM sequence: CTG
tgcctaaaaataaccaagta

SEQ ID NO: 311190 - DNA, 20 bp, Artificial Sequence
  Description of Artificial Sequence: Synthetic oligonucleotide
  Target: ATXN1; (+) strand; PAM type: YTN; PAM sequence: CTA
aaaataaccaagtaactacc

SEQ ID NO: 311191 - DNA, 20 bp, Artificial Sequence
  Description of Artificial Sequence: Synthetic oligonucleotide
  Target: ATXN1; (+) strand; PAM type: YTN; PAM sequence: CTA
cccactgctgtgtgcaatat

SEQ ID NO: 311192 - DNA, 20 bp, Artificial Sequence
  Description of Artificial Sequence: Synthetic oligonucleotide
  Target: ATXN1; (+) strand; PAM type: YTN; PAM sequence: CTG
ctgtgtgcaatatataacaa

SEQ ID NO: 311193 - DNA, 20 bp, Artificial Sequence
  Description of Artificial Sequence: Synthetic oligonucleotide
  Target: ATXN1; (+) strand; PAM type: YTN; PAM sequence: CTG
tgtgcaatatataacaatga

SEQ ID NO: 311194 - DNA, 20 bp, Artificial Sequence
  Description of Artificial Sequence: Synthetic oligonucleotide
  Target: ATXN1; (+) strand; PAM type: YTN; PAM sequence: TTT
aaatattaaaaacagcctgc

SEQ ID NO: 311195 - DNA, 20 bp, Artificial Sequence
  Description of Artificial Sequence: Synthetic oligonucleotide
  Target: ATXN1; (+) strand; PAM type: YTN; PAM sequence: TTA
aatattaaaaacagcctgca

SEQ ID NO: 311196 - DNA, 20 bp, Artificial Sequence
  Description of Artificial Sequence: Synthetic oligonucleotide
  Target: ATXN1; (+) strand; PAM type: YTN; PAM sequence: TTA
aaaacagcctgcattataaa

SEQ ID NO: 311197 - DNA, 20 bp, Artificial Sequence
  Description of Artificial Sequence: Synthetic oligonucleotide
  Target: ATXN1; (+) strand; PAM type: YTN; PAM sequence: CTG
cattataaaacacaaatgtc

SEQ ID NO: 311198 - DNA, 20 bp, Artificial Sequence
  Description of Artificial Sequence: Synthetic oligonucleotide
  Target: ATXN1; (+) strand; PAM type: YTN; PAM sequence: TTA
taaaacacaaatgtcattga

SEQ ID NO: 311199 - DNA, 20 bp, Artificial Sequence
  Description of Artificial Sequence: Synthetic oligonucleotide
  Target: ATXN1; (+) strand; PAM type: YTN; PAM sequence: TTG
agatgtgactactagattgc

SEQ ID NO: 311200 - DNA, 20 bp, Artificial Sequence
  Description of Artificial Sequence: Synthetic oligonucleotide
  Target: ATXN1; (+) strand; PAM type: YTN; PAM sequence: CTA
ctagattgccaaaggagaac

SEQ ID NO: 311201 - DNA, 20 bp, Artificial Sequence
  Description of Artificial Sequence: Synthetic oligonucleotide
  Target: ATXN1; (+) strand; PAM type: YTN; PAM sequence: CTA
gattgccaaaggagaactta

SEQ ID NO: 311202 - DNA, 20 bp, Artificial Sequence
  Description of Artificial Sequence: Synthetic oligonucleotide
  Target: ATXN1; (+) strand; PAM type: YTN; PAM sequence: TTG
ccaaaggagaacttatttgc

SEQ ID NO: 311203 - DNA, 20 bp, Artificial Sequence
  Description of Artificial Sequence: Synthetic oligonucleotide
  Target: ATXN1; (+) strand; PAM type: YTN; PAM sequence: CTT
atttgcatacacacattccc

SEQ ID NO: 311204 - DNA, 20 bp, Artificial Sequence
  Description of Artificial Sequence: Synthetic oligonucleotide
  Target: ATXN1; (+) strand; PAM type: YTN; PAM sequence: TTA
tttgcatacacacattcccg

SEQ ID NO: 311205 - DNA, 20 bp, Artificial Sequence
  Description of Artificial Sequence: Synthetic oligonucleotide
  Target: ATXN1; (+) strand; PAM type: YTN; PAM sequence: TTT
gcatacacacattcccgtgc

SEQ ID NO: 311206 - DNA, 20 bp, Artificial Sequence
  Description of Artificial Sequence: Synthetic oligonucleotide
  Target: ATXN1; (+) strand; PAM type: YTN; PAM sequence: TTG
catacacacattcccgtgca

SEQ ID NO: 311207 - DNA, 20 bp, Artificial Sequence
  Description of Artificial Sequence: Synthetic oligonucleotide
  Target: ATXN1; (+) strand; PAM type: YTN; PAM sequence: TTC
ccgtgcatgcacgacaggat

SEQ ID NO: 311208 - DNA, 20 bp, Artificial Sequence
  Description of Artificial Sequence: Synthetic oligonucleotide
  Target: ATXN1; (+) strand; PAM type: YTN; PAM sequence: CTG
taaggcattagtttttattc

SEQ ID NO: 311209 - DNA, 20 bp, Artificial Sequence
  Description of Artificial Sequence: Synthetic oligonucleotide
  Target: ATXN1; (+) strand; PAM type: YTN; PAM sequence: TTA
gtttttattctgtgggtgta

SEQ ID NO: 311210 - DNA, 20 bp, Artificial Sequence
  Description of Artificial Sequence: Synthetic oligonucleotide
  Target: ATXN1; (+) strand; PAM type: YTN; PAM sequence: TTT
ttattctgtgggtgtaatag

SEQ ID NO: 311211 - DNA, 20 bp, Artificial Sequence
  Description of Artificial Sequence: Synthetic oligonucleotide
  Target: ATXN1; (+) strand; PAM type: YTN; PAM sequence: TTT
tattctgtgggtgtaatagg

SEQ ID NO: 311212 - DNA, 20 bp, Artificial Sequence
  Description of Artificial Sequence: Synthetic oligonucleotide
  Target: ATXN1; (+) strand; PAM type: YTN; PAM sequence: TTT
attctgtgggtgtaataggg

SEQ ID NO: 311213 - DNA, 20 bp, Artificial Sequence
  Description of Artificial Sequence: Synthetic oligonucleotide
  Target: ATXN1; (+) strand; PAM type: YTN; PAM sequence: TTA
ttctgtgggtgtaatagggt

SEQ ID NO: 311214 - DNA, 20 bp, Artificial Sequence
  Description of Artificial Sequence: Synthetic oligonucleotide
  Target: ATXN1; (+) strand; PAM type: YTN; PAM sequence: TTC
tgtgggtgtaatagggtctt

SEQ ID NO: 311215 - DNA, 20 bp, Artificial Sequence
  Description of Artificial Sequence: Synthetic oligonucleotide
  Target: ATXN1; (+) strand; PAM type: YTN; PAM sequence: CTG
tgggtgtaatagggtcttct

SEQ ID NO: 311216 - DNA, 20 bp, Artificial Sequence
  Description of Artificial Sequence: Synthetic oligonucleotide
  Target: ATXN1; (+) strand; PAM type: YTN; PAM sequence: CTT
ctaattttgctaattgtatc

SEQ ID NO: 311217 - DNA, 20 bp, Artificial Sequence
  Description of Artificial Sequence: Synthetic oligonucleotide
  Target: ATXN1; (+) strand; PAM type: YTN; PAM sequence: TTC
taattttgctaattgtatcc

SEQ ID NO: 311218 - DNA, 20 bp, Artificial Sequence
  Description of Artificial Sequence: Synthetic oligonucleotide
  Target: ATXN1; (+) strand; PAM type: YTN; PAM sequence: CTA
attttgctaattgtatcctg

SEQ ID NO: 311219 - DNA, 20 bp, Artificial Sequence
  Description of Artificial Sequence: Synthetic oligonucleotide
  Target: ATXN1; (+) strand; PAM type: YTN; PAM sequence: TTT
tgctaattgtatcctgtgga

SEQ ID NO: 311220 - DNA, 20 bp, Artificial Sequence
  Description of Artificial Sequence: Synthetic oligonucleotide
  Target: ATXN1; (+) strand; PAM type: YTN; PAM sequence: TTT
gctaattgtatcctgtggat

SEQ ID NO: 311221 - DNA, 20 bp, Artificial Sequence
  Description of Artificial Sequence: Synthetic oligonucleotide
  Target: ATXN1; (+) strand; PAM type: YTN; PAM sequence: TTG
ctaattgtatcctgtggatc

SEQ ID NO: 311222 - DNA, 20 bp, Artificial Sequence
  Description of Artificial Sequence: Synthetic oligonucleotide
  Target: ATXN1; (+) strand; PAM type: YTN; PAM sequence: CTA
attgtatcctgtggatctcg

SEQ ID NO: 311223 - DNA, 20 bp, Artificial Sequence
  Description of Artificial Sequence: Synthetic oligonucleotide
  Target: ATXN1; (+) strand; PAM type: YTN; PAM sequence: TTG
tatcctgtggatctcgcagg

SEQ ID NO: 311224 - DNA, 20 bp, Artificial Sequence
  Description of Artificial Sequence: Synthetic oligonucleotide
  Target: ATXN1; (+) strand; PAM type: YTN; PAM sequence: CTG
tggatctcgcagggaagcta

SEQ ID NO: 311225 - DNA, 20 bp, Artificial Sequence
  Description of Artificial Sequence: Synthetic oligonucleotide
  Target: ATXN1; (+) strand; PAM type: YTN; PAM sequence: CTC
gcagggaagctaagaatctc

SEQ ID NO: 311226 - DNA, 20 bp, Artificial Sequence
  Description of Artificial Sequence: Synthetic oligonucleotide
  Target: ATXN1; (+) strand; PAM type: YTN; PAM sequence: CTA
agaatctcttcggggacaga

SEQ ID NO: 311227 - DNA, 20 bp, Artificial Sequence
  Description of Artificial Sequence: Synthetic oligonucleotide
  Target: ATXN1; (+) strand; PAM type: YTN; PAM sequence: CTC
ttcggggacagaaccagttt

SEQ ID NO: 311228 - DNA, 20 bp, Artificial Sequence
  Description of Artificial Sequence: Synthetic oligonucleotide
  Target: ATXN1; (+) strand; PAM type: YTN; PAM sequence: CTT
cggggacagaaccagtttgg

SEQ ID NO: 311229 - DNA, 20 bp, Artificial Sequence
  Description of Artificial Sequence: Synthetic oligonucleotide
  Target: ATXN1; (+) strand; PAM type: YTN; PAM sequence: TTC
ggggacagaaccagtttgga

SEQ ID NO: 311230 - DNA, 20 bp, Artificial Sequence
  Description of Artificial Sequence: Synthetic oligonucleotide
  Target: ATXN1; (+) strand; PAM type: YTN; PAM sequence: TTT
ggaggagtccctactgcaca

SEQ ID NO: 311231 - DNA, 20 bp, Artificial Sequence
  Description of Artificial Sequence: Synthetic oligonucleotide
  Target: ATXN1; (+) strand; PAM type: YTN; PAM sequence: TTG
gaggagtccctactgcacag

SEQ ID NO: 311232 - DNA, 20 bp, Artificial Sequence
  Description of Artificial Sequence: Synthetic oligonucleotide
  Target: ATXN1; (+) strand; PAM type: YTN; PAM sequence: CTA
ctgcacagcatacggtaaac

SEQ ID NO: 311233 - DNA, 20 bp, Artificial Sequence
  Description of Artificial Sequence: Synthetic oligonucleotide
  Target: ATXN1; (+) strand; PAM type: YTN; PAM sequence: CTG
cacagcatacggtaaacaaa

SEQ ID NO: 311234 - DNA, 20 bp, Artificial Sequence
  Description of Artificial Sequence: Synthetic oligonucleotide
  Target: ATXN1; (+) strand; PAM type: YTN; PAM sequence: CTT
gcctttcttgttagccacat

SEQ ID NO: 311235 - DNA, 20 bp, Artificial Sequence
  Description of Artificial Sequence: Synthetic oligonucleotide
  Target: ATXN1; (+) strand; PAM type: YTN; PAM sequence: TTG
cctttcttgttagccacatc

SEQ ID NO: 311236 - DNA, 20 bp, Artificial Sequence
  Description of Artificial Sequence: Synthetic oligonucleotide
  Target: ATXN1; (+) strand; PAM type: YTN; PAM sequence: CTT
tcttgttagccacatcgcgc

SEQ ID NO: 311237 - DNA, 20 bp, Artificial Sequence
  Description of Artificial Sequence: Synthetic oligonucleotide
  Target: ATXN1; (+) strand; PAM type: YTN; PAM sequence: TTT
cttgttagccacatcgcgca

SEQ ID NO: 311238 - DNA, 20 bp, Artificial Sequence
  Description of Artificial Sequence: Synthetic oligonucleotide
  Target: ATXN1; (+) strand; PAM type: YTN; PAM sequence: TTC
ttgttagccacatcgcgcat

SEQ ID NO: 311239 - DNA, 20 bp, Artificial Sequence
  Description of Artificial Sequence: Synthetic oligonucleotide
  Target: ATXN1; (+) strand; PAM type: YTN; PAM sequence: CTT
gttagccacatcgcgcatta

SEQ ID NO: 311240 - DNA, 20 bp, Artificial Sequence
  Description of Artificial Sequence: Synthetic oligonucleotide
  Target: ATXN1; (+) strand; PAM type: YTN; PAM sequence: TTG
ttagccacatcgcgcattat

SEQ ID NO: 311241 - DNA, 20 bp, Artificial Sequence
  Description of Artificial Sequence: Synthetic oligonucleotide
  Target: ATXN1; (+) strand; PAM type: YTN; PAM sequence: TTA
gccacatcgcgcattatata

SEQ ID NO: 311242 - DNA, 20 bp, Artificial Sequence
  Description of Artificial Sequence: Synthetic oligonucleotide
  Target: ATXN1; (+) strand; PAM type: YTN; PAM sequence: TTA
tataaccagcttcttccgac

SEQ ID NO: 311243 - DNA, 20 bp, Artificial Sequence
  Description of Artificial Sequence: Synthetic oligonucleotide
  Target: ATXN1; (+) strand; PAM type: YTN; PAM sequence: CTT
cttccgactgtttttttttt

SEQ ID NO: 311244 - DNA, 20 bp, Artificial Sequence
  Description of Artificial Sequence: Synthetic oligonucleotide
  Target: ATXN1; (+) strand; PAM type: YTN; PAM sequence: TTC
ttccgactgttttttttttt

SEQ ID NO: 311245 - DNA, 20 bp, Artificial Sequence
  Description of Artificial Sequence: Synthetic oligonucleotide
  Target: ATXN1; (+) strand; PAM type: YTN; PAM sequence: CTT
ccgactgttttttttttttt

SEQ ID NO: 311246 - DNA, 20 bp, Artificial Sequence
  Description of Artificial Sequence: Synthetic oligonucleotide
  Target: ATXN1; (+) strand; PAM type: YTN; PAM sequence: TTC
cgactgtttttttttttttt

SEQ ID NO: 311247 - DNA, 20 bp, Artificial Sequence
  Description of Artificial Sequence: Synthetic oligonucleotide
  Target: ATXN1; (+) strand; PAM type: YTN; PAM sequence: CTG
tttttttttttttttttttt

SEQ ID NO: 311248 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 311249 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 311250 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 311251 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 311252 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 311253 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 311254 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 311255 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttgc

SEQ ID NO: 311256 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgcc

SEQ ID NO: 311257 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgccc

SEQ ID NO: 311258 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgccct

SEQ ID NO: 311259 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgccctt

SEQ ID NO: 311260 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgccctta

SEQ ID NO: 311261 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgcccttac

SEQ ID NO: 311262 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgcccttact

SEQ ID NO: 311263 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgcccttacta

SEQ ID NO: 311264 - DNA, 20 bp, Artificial Sequence
  Description of Artificial Sequence: Synthetic oligonucleotide
  Target: ATXN1; (+) strand; PAM type: YTN; PAM sequence: TTT
tttttttttgcccttactac

SEQ ID NO: 311265 - DNA, 20 bp, Artificial Sequence
  Description of Artificial Sequence: Synthetic oligonucleotide
  Target: ATXN1; (+) strand; PAM type: YTN; PAM sequence: TTT
ttttttttgcccttactact

SEQ ID NO: 311266 - DNA, 20 bp, Artificial Sequence
  Description of Artificial Sequence: Synthetic oligonucleotide
  Target: ATXN1; (+) strand; PAM type: YTN; PAM sequence: TTT
tttttttgcccttactactc

SEQ ID NO: 311267 - DNA, 20 bp, Artificial Sequence
  Description of Artificial Sequence: Synthetic oligonucleotide
  Target: ATXN1; (+) strand; PAM type: YTN; PAM sequence: TTT
ttttttgcccttactactct

SEQ ID NO: 311268 - DNA, 20 bp, Artificial Sequence
  Description of Artificial Sequence: Synthetic oligonucleotide
  Target: ATXN1; (+) strand; PAM type: YTN; PAM sequence: TTT
tttttgcccttactactctt

SEQ ID NO: 311269 - DNA, 20 bp, Artificial Sequence
  Description of Artificial Sequence: Synthetic oligonucleotide
  Target: ATXN1; (+) strand; PAM type: YTN; PAM sequence: TTT
ttttgcccttactactcttc

SEQ ID NO: 311270 - DNA, 20 bp, Artificial Sequence
  Description of Artificial Sequence: Synthetic oligonucleotide
  Target: ATXN1; (+) strand; PAM type: YTN; PAM sequence: TTT
tttgcccttactactcttca

SEQ ID NO: 311271 - DNA, 20 bp, Artificial Sequence
  Description of Artificial Sequence: Synthetic oligonucleotide
  Target: ATXN1; (+) strand; PAM type: YTN; PAM sequence: TTT
ttgcccttactactcttcag

SEQ ID NO: 311272 - DNA, 20 bp, Artificial Sequence
  Description of Artificial Sequence: Synthetic oligonucleotide
  Target: ATXN1; (+) strand; PAM type: YTN; PAM sequence: TTT
tgcccttactactcttcagc

SEQ ID NO: 311273 - DNA, 20 bp, Artificial Sequence
  Description of Artificial Sequence: Synthetic oligonucleotide
  Target: ATXN1; (+) strand; PAM type: YTN; PAM sequence: TTT
gcccttactactcttcagca

SEQ ID NO: 311274 - DNA, 20 bp, Artificial Sequence
  Description of Artificial Sequence: Synthetic oligonucleotide
  Target: ATXN1; (+) strand; PAM type: YTN; PAM sequence: TTG
cccttactactcttcagcaa

SEQ ID NO: 311275 - DNA, 20 bp, Artificial Sequence
  Description of Artificial Sequence: Synthetic oligonucleotide
  Target: ATXN1; (+) strand; PAM type: YTN; PAM sequence: CTT
actactcttcagcaatttcc

SEQ ID NO: 311276 - DNA, 20 bp, Artificial Sequence
  Description of Artificial Sequence: Synthetic oligonucleotide
  Target: ATXN1; (+) strand; PAM type: YTN; PAM sequence: TTA
ctactcttcagcaatttccc

SEQ ID NO: 311277 - DNA, 20 bp, Artificial Sequence
  Description of Artificial Sequence: Synthetic oligonucleotide
  Target: ATXN1; (+) strand; PAM type: YTN; PAM sequence: CTA
ctcttcagcaatttccctct

SEQ ID NO: 311278 - DNA, 20 bp, Artificial Sequence
  Description of Artificial Sequence: Synthetic oligonucleotide
  Target: ATXN1; (+) strand; PAM type: YTN; PAM sequence: CTC
ttcagcaatttccctcttct

SEQ ID NO: 311279 - DNA, 20 bp, Artificial Sequence
  Description of Artificial Sequence: Synthetic oligonucleotide
  Target: ATXN1; (+) strand; PAM type: YTN; PAM sequence: CTT
cagcaatttccctcttctca

SEQ ID NO: 311280 - DNA, 20 bp, Artificial Sequence
  Description of Artificial Sequence: Synthetic oligonucleotide
  Target: ATXN1; (+) strand; PAM type: YTN; PAM sequence: TTC
agcaatttccctcttctcaa

SEQ ID NO: 311281 - DNA, 20 bp, Artificial Sequence
  Description of Artificial Sequence: Synthetic oligonucleotide
  Target: ATXN1; (+) strand; PAM type: YTN; PAM sequence: TTT
ccctcttctcaaatatttat

SEQ ID NO: 311282 - DNA, 20 bp, Artificial Sequence
  Description of Artificial Sequence: Synthetic oligonucleotide
  Target: ATXN1; (+) strand; PAM type: YTN; PAM sequence: TTC
cctcttctcaaatatttata

SEQ ID NO: 311283 - DNA, 20 bp, Artificial Sequence
  Description of Artificial Sequence: Synthetic oligonucleotide
  Target: ATXN1; (+) strand; PAM type: YTN; PAM sequence: CTC
ttctcaaatatttatattac

SEQ ID NO: 311284 - DNA, 20 bp, Artificial Sequence
  Description of Artificial Sequence: Synthetic oligonucleotide
  Target: ATXN1; (+) strand; PAM type: YTN; PAM sequence: CTT
ctcaaatatttatattaccc

SEQ ID NO: 311285 - DNA, 20 bp, Artificial Sequence
  Description of Artificial Sequence: Synthetic oligonucleotide
  Target: ATXN1; (+) strand; PAM type: YTN; PAM sequence: TTC
tcaaatatttatattaccct

SEQ ID NO: 311286 - DNA, 20 bp, Artificial Sequence
  Description of Artificial Sequence: Synthetic oligonucleotide
  Target: ATXN1; (+) strand; PAM type: YTN; PAM sequence: CTC
aaatatttatattacccttt

SEQ ID NO: 311287 - DNA, 20 bp, Artificial Sequence
  Description of Artificial Sequence: Synthetic oligonucleotide
  Target: ATXN1; (+) strand; PAM type: YTN; PAM sequence: TTT
atattacccttttatctgta

SEQ ID NO: 311288 - DNA, 20 bp, Artificial Sequence
  Description of Artificial Sequence: Synthetic oligonucleotide
  Target: ATXN1; (+) strand; PAM type: YTN; PAM sequence: TTA
tattacccttttatctgtag

SEQ ID NO: 311289 - DNA, 20 bp, Artificial Sequence
  Description of Artificial Sequence: Synthetic oligonucleotide
  Target: ATXN1; (+) strand; PAM type: YTN; PAM sequence: TTA
cccttttatctgtaggatta

SEQ ID NO: 311290 - DNA, 20 bp, Artificial Sequence
  Description of Artificial Sequence: Synthetic oligonucleotide
  Target: ATXN1; (+) strand; PAM type: YTN; PAM sequence: CTT
ttatctgtaggattatatac

SEQ ID NO: 311291 - DNA, 20 bp, Artificial Sequence
  Description of Artificial Sequence: Synthetic oligonucleotide
  Target: ATXN1; (+) strand; PAM type: YTN; PAM sequence: TTT
tatctgtaggattatatacc

SEQ ID NO: 311292 - DNA, 20 bp, Artificial Sequence
  Description of Artificial Sequence: Synthetic oligonucleotide
  Target: ATXN1; (+) strand; PAM type: YTN; PAM sequence: TTT
atctgtaggattatatacca

SEQ ID NO: 311293 - DNA, 20 bp, Artificial Sequence
  Description of Artificial Sequence: Synthetic oligonucleotide
  Target: ATXN1; (+) strand; PAM type: YTN; PAM sequence: TTA
tctgtaggattatataccaa

SEQ ID NO: 311294 - DNA, 20 bp, Artificial Sequence
  Description of Artificial Sequence: Synthetic oligonucleotide
  Target: ATXN1; (+) strand; PAM type: YTN; PAM sequence: CTG
taggattatataccaagaaa

SEQ ID NO: 311295 - DNA, 20 bp, Artificial Sequence
  Description of Artificial Sequence: Synthetic oligonucleotide
  Target: ATXN1; (+) strand; PAM type: YTN; PAM sequence: TTA
tataccaagaaagcaaaaca

SEQ ID NO: 311296 - DNA, 20 bp, Artificial Sequence
  Description of Artificial Sequence: Synthetic oligonucleotide
  Target: ATXN1; (+) strand; PAM type: YTN; PAM sequence: CTC
gaaccgaatccccgccgtcc

SEQ ID NO: 311297 - DNA, 20 bp, Artificial Sequence
  Description of Artificial Sequence: Synthetic oligonucleotide
  Target: ATXN1; (+) strand; PAM type: YTN; PAM sequence: CTT
agaaacggatttttttttgt

SEQ ID NO: 311298 - DNA, 20 bp, Artificial Sequence
  Description of Artificial Sequence: Synthetic oligonucleotide
  Target: ATXN1; (+) strand; PAM type: YTN; PAM sequence: TTA
gaaacggatttttttttgtt

SEQ ID NO: 311299 - DNA, 20 bp, Artificial Sequence
  Description of Artificial Sequence: Synthetic oligonucleotide
  Target: ATXN1; (+) strand; PAM type: YTN; PAM sequence: TTT
ttttttgttttgttttgttt

SEQ ID NO: 311300 - DNA, 20 bp, Artificial Sequence
  Description of Artificial Sequence: Synthetic oligonucleotide
  Target: ATXN1; (+) strand; PAM type: YTN; PAM sequence: TTT
tttttgttttgttttgtttt

SEQ ID NO: 311301 - DNA, 20 bp, Artificial Sequence
  Description of Artificial Sequence: Synthetic oligonucleotide
  Target: ATXN1; (+) strand; PAM type: YTN; PAM sequence: TTT
ttttgttttgttttgttttc

SEQ ID NO: 311302 - DNA, 20 bp, Artificial Sequence
  Description of Artificial Sequence: Synthetic oligonucleotide
  Target: ATXN1; (+) strand; PAM type: YTN; PAM sequence: TTT
tttgttttgttttgttttct

SEQ ID NO: 311303 - DNA, 20 bp, Artificial Sequence
  Description of Artificial Sequence: Synthetic oligonucleotide
  Target: ATXN1; (+) strand; PAM type: YTN; PAM sequence: TTT
ttgttttgttttgttttctg

SEQ ID NO: 311304 - DNA, 20 bp, Artificial Sequence
  Description of Artificial Sequence: Synthetic oligonucleotide
  Target: ATXN1; (+) strand; PAM type: YTN; PAM sequence: TTT
tgttttgttttgttttctgg

SEQ ID NO: 311305 - DNA, 20 bp, Artificial Sequence
  Description of Artificial Sequence: Synthetic oligonucleotide
  Target: ATXN1; (+) strand; PAM type: YTN; PAM sequence: TTT
gttttgttttgttttctggc

SEQ ID NO: 311306 - DNA, 20 bp, Artificial Sequence
  Description of Artificial Sequence: Synthetic oligonucleotide
  Target: ATXN1; (+) strand; PAM type: YTN; PAM sequence: TTG
ttttgttttgttttctggca

SEQ ID NO: 311307 - DNA, 20 bp, Artificial Sequence
  Description of Artificial Sequence: Synthetic oligonucleotide
  Target: ATXN1; (+) strand; PAM type: YTN; PAM sequence: TTT
tgttttgttttctggcagag

SEQ ID NO: 311308 - DNA, 20 bp, Artificial Sequence
  Description of Artificial Sequence: Synthetic oligonucleotide
  Target: ATXN1; (+) strand; PAM type: YTN; PAM sequence: TTT
gttttgttttctggcagagt

SEQ ID NO: 311309 - DNA, 20 bp, Artificial Sequence
  Description of Artificial Sequence: Synthetic oligonucleotide
  Target: ATXN1; (+) strand; PAM type: YTN; PAM sequence: TTG
ttttgttttctggcagagtc

SEQ ID NO: 311310 - DNA, 20 bp, Artificial Sequence
  Description of Artificial Sequence: Synthetic oligonucleotide
  Target: ATXN1; (+) strand; PAM type: YTN; PAM sequence: TTT
tgttttctggcagagtctcg

SEQ ID NO: 311311 - DNA, 20 bp, Artificial Sequence
  Description of Artificial Sequence: Synthetic oligonucleotide
  Target: ATXN1; (+) strand; PAM type: YTN; PAM sequence: TTT
gttttctggcagagtctcga

SEQ ID NO: 311312 - DNA, 20 bp, Artificial Sequence
  Description of Artificial Sequence: Synthetic oligonucleotide
  Target: ATXN1; (+) strand; PAM type: YTN; PAM sequence: TTG
ttttctggcagagtctcgat

SEQ ID NO: 311313 - DNA, 20 bp, Artificial Sequence
  Description of Artificial Sequence: Synthetic oligonucleotide
  Target: ATXN1; (+) strand; PAM type: YTN; PAM sequence: TTT
tctggcagagtctcgatcac

SEQ ID NO: 311314 - DNA, 20 bp, Artificial Sequence
  Description of Artificial Sequence: Synthetic oligonucleotide
  Target: ATXN1; (+) strand; PAM type: YTN; PAM sequence: TTT
ctggcagagtctcgatcacc

SEQ ID NO: 311315 - DNA, 20 bp, Artificial Sequence
  Description of Artificial Sequence: Synthetic oligonucleotide
  Target: ATXN1; (+) strand; PAM type: YTN; PAM sequence: TTC
tggcagagtctcgatcacca

SEQ ID NO: 311316 - DNA, 20 bp, Artificial Sequence
  Description of Artificial Sequence: Synthetic oligonucleotide
  Target: ATXN1; (+) strand; PAM type: YTN; PAM sequence: CTG
gcagagtctcgatcaccacc

SEQ ID NO: 311317 - DNA, 20 bp, Artificial Sequence
  Description of Artificial Sequence: Synthetic oligonucleotide
  Target: ATXN1; (+) strand; PAM type: YTN; PAM sequence: CTC
gatcaccaccctacttccac

SEQ ID NO: 311318 - DNA, 20 bp, Artificial Sequence
  Description of Artificial Sequence: Synthetic oligonucleotide
  Target: ATXN1; (+) strand; PAM type: YTN; PAM sequence: CTA
cttccacccccactaaggtt

SEQ ID NO: 311319 - DNA, 20 bp, Artificial Sequence
  Description of Artificial Sequence: Synthetic oligonucleotide
  Target: ATXN1; (+) strand; PAM type: YTN; PAM sequence: CTT
ccacccccactaaggttctt

SEQ ID NO: 311320 - DNA, 20 bp, Artificial Sequence
  Description of Artificial Sequence: Synthetic oligonucleotide
  Target: ATXN1; (+) strand; PAM type: YTN; PAM sequence: TTC
cacccccactaaggttcttg

SEQ ID NO: 311321 - DNA, 20 bp, Artificial Sequence
  Description of Artificial Sequence: Synthetic oligonucleotide
  Target: ATXN1; (+) strand; PAM type: YTN; PAM sequence: CTA
aggttcttgctcaatctccc

SEQ ID NO: 311322 - DNA, 20 bp, Artificial Sequence
  Description of Artificial Sequence: Synthetic oligonucleotide
  Target: ATXN1; (+) strand; PAM type: YTN; PAM sequence: TTC
ttgctcaatctccctagaaa

SEQ ID NO: 311323 - DNA, 20 bp, Artificial Sequence
  Description of Artificial Sequence: Synthetic oligonucleotide
  Target: ATXN1; (+) strand; PAM type: YTN; PAM sequence: CTT
gctcaatctccctagaaaac

SEQ ID NO: 311324 - DNA, 20 bp, Artificial Sequence
  Description of Artificial Sequence: Synthetic oligonucleotide
  Target: ATXN1; (+) strand; PAM type: YTN; PAM sequence: TTG
ctcaatctccctagaaaacc

SEQ ID NO: 311325 - DNA, 20 bp, Artificial Sequence
  Description of Artificial Sequence: Synthetic oligonucleotide
  Target: ATXN1; (+) strand; PAM type: YTN; PAM sequence: CTC
aatctccctagaaaacctga

SEQ ID NO: 311326 - DNA, 20 bp, Artificial Sequence
  Description of Artificial Sequence: Synthetic oligonucleotide
  Target: ATXN1; (+) strand; PAM type: YTN; PAM sequence: CTC
cctagaaaacctgaattgtt

SEQ ID NO: 311327 - DNA, 20 bp, Artificial Sequence
  Description of Artificial Sequence: Synthetic oligonucleotide
  Target: ATXN1; (+) strand; PAM type: YTN; PAM sequence: CTA
gaaaacctgaattgtttcat

SEQ ID NO: 311328 - DNA, 20 bp, Artificial Sequence
  Description of Artificial Sequence: Synthetic oligonucleotide
  Target: ATXN1; (+) strand; PAM type: YTN; PAM sequence: CTG
aattgtttcatccctttcag

SEQ ID NO: 311329 - DNA, 20 bp, Artificial Sequence
  Description of Artificial Sequence: Synthetic oligonucleotide
  Target: ATXN1; (+) strand; PAM type: YTN; PAM sequence: TTG
tttcatccctttcagtcagc

SEQ ID NO: 311330 - DNA, 20 bp, Artificial Sequence
  Description of Artificial Sequence: Synthetic oligonucleotide
  Target: ATXN1; (+) strand; PAM type: YTN; PAM sequence: TTT
catccctttcagtcagcccc

SEQ ID NO: 311331 - DNA, 20 bp, Artificial Sequence
  Description of Artificial Sequence: Synthetic oligonucleotide
  Target: ATXN1; (+) strand; PAM type: YTN; PAM sequence: TTC
atccctttcagtcagccccc

SEQ ID NO: 311332 - DNA, 20 bp, Artificial Sequence
  Description of Artificial Sequence: Synthetic oligonucleotide
  Target: ATXN1; (+) strand; PAM type: YTN; PAM sequence: CTT
tcagtcagccccctacgtgg

SEQ ID NO: 311333 - DNA, 20 bp, Artificial Sequence
  Description of Artificial Sequence: Synthetic oligonucleotide
  Target: ATXN1; (+) strand; PAM type: YTN; PAM sequence: TTT
cagtcagccccctacgtggt

SEQ ID NO: 311334 - DNA, 20 bp, Artificial Sequence
  Description of Artificial Sequence: Synthetic oligonucleotide
  Target: ATXN1; (+) strand; PAM type: YTN; PAM sequence: TTC
agtcagccccctacgtggtc

SEQ ID NO: 311335 - DNA, 20 bp, Artificial Sequence
  Description of Artificial Sequence: Synthetic oligonucleotide
  Target: ATXN1; (+) strand; PAM type: YTN; PAM sequence: CTA
cgtggtctgaaacaaaatga

SEQ ID NO: 311336 - DNA, 20 bp, Artificial Sequence
  Description of Artificial Sequence: Synthetic oligonucleotide
  Target: ATXN1; (+) strand; PAM type: YTN; PAM sequence: CTG
aaacaaaatgaaagcacaag

SEQ ID NO: 311337 - DNA, 20 bp, Artificial Sequence
  Description of Artificial Sequence: Synthetic oligonucleotide
  Target: ATXN1; (+) strand; PAM type: YTN; PAM sequence: TTT
aagaaggcagcctgaaggcg

SEQ ID NO: 311338 - DNA, 20 bp, Artificial Sequence
  Description of Artificial Sequence: Synthetic oligonucleotide
  Target: ATXN1; (+) strand; PAM type: YTN; PAM sequence: TTA
agaaggcagcctgaaggcgg

SEQ ID NO: 311339 - DNA, 20 bp, Artificial Sequence
  Description of Artificial Sequence: Synthetic oligonucleotide
  Target: ATXN1; (+) strand; PAM type: YTN; PAM sequence: CTG
aaggcggggggctgaagagg

SEQ ID NO: 311340 - DNA, 20 bp, Artificial Sequence
  Description of Artificial Sequence: Synthetic oligonucleotide
  Target: ATXN1; (+) strand; PAM type: YTN; PAM sequence: CTG
aagaggggtcggggcgctgc

SEQ ID NO: 311341 - DNA, 20 bp, Artificial Sequence
  Description of Artificial Sequence: Synthetic oligonucleotide
  Target: ATXN1; (+) strand; PAM type: YTN; PAM sequence: CTG
cagagtcagccaagtagcca

SEQ ID NO: 311342 - DNA, 20 bp, Artificial Sequence
  Description of Artificial Sequence: Synthetic oligonucleotide
  Target: ATXN1; (+) strand; PAM type: YTN; PAM sequence: CTC
cgcgtcgcgacggccctcgc

SEQ ID NO: 311343 - DNA, 20 bp, Artificial Sequence
  Description of Artificial Sequence: Synthetic oligonucleotide
  Target: ATXN1; (+) strand; PAM type: YTN; PAM sequence: CTC
gccccccgcccggcgcgcgc

SEQ ID NO: 311344 - DNA, 20 bp, Artificial Sequence
  Description of Artificial Sequence: Synthetic oligonucleotide
  Target: ATXN1; (+) strand; PAM type: YTN; PAM sequence: CTC
acacactcactcacactcac

SEQ ID NO: 311345 - DNA, 20 bp, Artificial Sequence
  Description of Artificial Sequence: Synthetic oligonucleotide
  Target: ATXN1; (+) strand; PAM type: YTN; PAM sequence: CTC
actcacactcacgccgcgct

SEQ ID NO: 311346 - DNA, 20 bp, Artificial Sequence
  Description of Artificial Sequence: Synthetic oligonucleotide
  Target: ATXN1; (+) strand; PAM type: YTN; PAM sequence: CTC
acactcacgccgcgctccga

SEQ ID NO: 311347 - DNA, 20 bp, Artificial Sequence
  Description of Artificial Sequence: Synthetic oligonucleotide
  Target: ATXN1; (+) strand; PAM type: YTN; PAM sequence: CTC
acgccgcgctccgacaccgc

SEQ ID NO: 311348 - DNA, 20 bp, Artificial Sequence
  Description of Artificial Sequence: Synthetic oligonucleotide
  Target: ATXN1; (+) strand; PAM type: YTN; PAM sequence: CTC
cgacaccgcctcacctctcg

SEQ ID NO: 311349 - DNA, 20 bp, Artificial Sequence
  Description of Artificial Sequence: Synthetic oligonucleotide
  Target: ATXN1; (+) strand; PAM type: YTN; PAM sequence: CTC
acctctcgctccgcccgtcc

SEQ ID NO: 311350 - DNA, 20 bp, Artificial Sequence
  Description of Artificial Sequence: Synthetic oligonucleotide
  Target: ATXN1; (+) strand; PAM type: YTN; PAM sequence: CTC
tcgctccgcccgtccggccc

SEQ ID NO: 311351 - DNA, 20 bp, Artificial Sequence
  Description of Artificial Sequence: Synthetic oligonucleotide
  Target: ATXN1; (+) strand; PAM type: YTN; PAM sequence: CTC
gctccgcccgtccggccccc

SEQ ID NO: 311352 - DNA, 20 bp, Artificial Sequence
  Description of Artificial Sequence: Synthetic oligonucleotide
  Target: ATXN1; (+) strand; PAM type: YTN; PAM sequence: CTC
cgcccgtccggcccccttcc

SEQ ID NO: 311353 - DNA, 20 bp, Artificial Sequence
  Description of Artificial Sequence: Synthetic oligonucleotide
  Target: ATXN1; (+) strand; PAM type: YTN; PAM sequence: CTT
ccctgccccctgcgggaccg

SEQ ID NO: 311354 - DNA, 20 bp, Artificial Sequence
  Description of Artificial Sequence: Synthetic oligonucleotide
  Target: ATXN1; (+) strand; PAM type: YTN; PAM sequence: TTC
cctgccccctgcgggaccgg

SEQ ID NO: 311355 - DNA, 20 bp, Artificial Sequence
  Description of Artificial Sequence: Synthetic oligonucleotide
  Target: ATXN1; (+) strand; PAM type: YTN; PAM sequence: CTG
ccccctgcgggaccggcctg

SEQ ID NO: 311356 - DNA, 20 bp, Artificial Sequence
  Description of Artificial Sequence: Synthetic oligonucleotide
  Target: ATXN1; (+) strand; PAM type: YTN; PAM sequence: CTG
cgggaccggcctgcgcgcag

SEQ ID NO: 311357 - DNA, 20 bp, Artificial Sequence
  Description of Artificial Sequence: Synthetic oligonucleotide
  Target: ATXN1; (+) strand; PAM type: YTN; PAM sequence: CTG
cgcgcagcactggaaccacg

SEQ ID NO: 311358 - DNA, 20 bp, Artificial Sequence
  Description of Artificial Sequence: Synthetic oligonucleotide
  Target: ATXN1; (+) strand; PAM type: YTN; PAM sequence: CTG
gaaccacgtaggaggaggcg

SEQ ID NO: 311359 - DNA, 20 bp, Artificial Sequence
  Description of Artificial Sequence: Synthetic oligonucleotide
  Target: ATXN1; (+) strand; PAM type: YTN; PAM sequence: CTC
cggcccggcccagagtgaac

SEQ ID NO: 311360 - DNA, 20 bp, Artificial Sequence
  Description of Artificial Sequence: Synthetic oligonucleotide
  Target: ATXN1; (+) strand; PAM type: YTN; PAM sequence: CTC
cagggcgcatcccaatcccc

SEQ ID NO: 311361 - DNA, 20 bp, Artificial Sequence
  Description of Artificial Sequence: Synthetic oligonucleotide
  Target: ATXN1; (+) strand; PAM type: YTN; PAM sequence: CTC
ctccgcggcggccgccgcct

SEQ ID NO: 311362 - DNA, 20 bp, Artificial Sequence
  Description of Artificial Sequence: Synthetic oligonucleotide
  Target: ATXN1; (+) strand; PAM type: YTN; PAM sequence: CTC
cgcggcggccgccgcctcct

SEQ ID NO: 311363 - DNA, 20 bp, Artificial Sequence
  Description of Artificial Sequence: Synthetic oligonucleotide
  Target: ATXN1; (+) strand; PAM type: YTN; PAM sequence: CTC
ctcctccttcccctcctcct

SEQ ID NO: 311364 - DNA, 20 bp, Artificial Sequence
  Description of Artificial Sequence: Synthetic oligonucleotide
  Target: ATXN1; (+) strand; PAM type: YTN; PAM sequence: CTC
ctccttcccctcctcctggc

SEQ ID NO: 311365 - DNA, 20 bp, Artificial Sequence
  Description of Artificial Sequence: Synthetic oligonucleotide
  Target: ATXN1; (+) strand; PAM type: YTN; PAM sequence: CTC
cttcccctcctcctggcttc

SEQ ID NO: 311366 - DNA, 20 bp, Artificial Sequence
  Description of Artificial Sequence: Synthetic oligonucleotide
  Target: ATXN1; (+) strand; PAM type: YTN; PAM sequence: CTT
cccctcctcctggcttcatt

SEQ ID NO: 311367 - DNA, 20 bp, Artificial Sequence
  Description of Artificial Sequence: Synthetic oligonucleotide
  Target: ATXN1; (+) strand; PAM type: YTN; PAM sequence: TTC
ccctcctcctggcttcattc

SEQ ID NO: 311368 - DNA, 20 bp, Artificial Sequence
  Description of Artificial Sequence: Synthetic oligonucleotide
  Target: ATXN1; (+) strand; PAM type: YTN; PAM sequence: CTC
ctcctggcttcattcaccct

SEQ ID NO: 311369 - DNA, 20 bp, Artificial Sequence
  Description of Artificial Sequence: Synthetic oligonucleotide
  Target: ATXN1; (+) strand; PAM type: YTN; PAM sequence: CTC
ctggcttcattcaccctccc

SEQ ID NO: 311370 - DNA, 20 bp, Artificial Sequence
  Description of Artificial Sequence: Synthetic oligonucleotide
  Target: ATXN1; (+) strand; PAM type: YTN; PAM sequence: CTG
gcttcattcaccctcccagc

SEQ ID NO: 311371 - DNA, 20 bp, Artificial Sequence
  Description of Artificial Sequence: Synthetic oligonucleotide
  Target: ATXN1; (+) strand; PAM type: YTN; PAM sequence: CTT
cattcaccctcccagcagcc

SEQ ID NO: 311372 - DNA, 20 bp, Artificial Sequence
  Description of Artificial Sequence: Synthetic oligonucleotide
  Target: ATXN1; (+) strand; PAM type: YTN; PAM sequence: TTC
attcaccctcccagcagccg

SEQ ID NO: 311373 - DNA, 20 bp, Artificial Sequence
  Description of Artificial Sequence: Synthetic oligonucleotide
  Target: ATXN1; (+) strand; PAM type: YTN; PAM sequence: TTC
accctcccagcagccgcgca

SEQ ID NO: 311374 - DNA, 20 bp, Artificial Sequence
  Description of Artificial Sequence: Synthetic oligonucleotide
  Target: ATXN1; (+) strand; PAM type: YTN; PAM sequence: CTC
ccagcagccgcgcagccgtt

SEQ ID NO: 311375 - DNA, 20 bp, Artificial Sequence
  Description of Artificial Sequence: Synthetic oligonucleotide
  Target: ATXN1; (+) strand; PAM type: YTN; PAM sequence: TTC
actcccggctcagggcagcg

SEQ ID NO: 311376 - DNA, 20 bp, Artificial Sequence
  Description of Artificial Sequence: Synthetic oligonucleotide
  Target: ATXN1; (+) strand; PAM type: YTN; PAM sequence: CTC
ccggctcagggcagcgcctg

SEQ ID NO: 311377 - DNA, 20 bp, Artificial Sequence
  Description of Artificial Sequence: Synthetic oligonucleotide
  Target: ATXN1; (+) strand; PAM type: YTN; PAM sequence: CTC
agggcagcgcctgccgcggc

SEQ ID NO: 311378 - DNA, 20 bp, Artificial Sequence
  Description of Artificial Sequence: Synthetic oligonucleotide
  Target: ATXN1; (+) strand; PAM type: YTN; PAM sequence: CTG
ccgcggctcctcgtctcctg

SEQ ID NO: 311379 - DNA, 20 bp, Artificial Sequence
  Description of Artificial Sequence: Synthetic oligonucleotide
  Target: ATXN1; (+) strand; PAM type: YTN; PAM sequence: CTC
ctcgtctcctgccgcgggtg

SEQ ID NO: 311380 - DNA, 20 bp, Artificial Sequence
  Description of Artificial Sequence: Synthetic oligonucleotide
  Target: ATXN1; (+) strand; PAM type: YTN; PAM sequence: CTC
gtctcctgccgcgggtgctg

SEQ ID NO: 311381 - DNA, 20 bp, Artificial Sequence
  Description of Artificial Sequence: Synthetic oligonucleotide
  Target: ATXN1; (+) strand; PAM type: YTN; PAM sequence: CTC
ctgccgcgggtgctggcggg

SEQ ID NO: 311382 - DNA, 20 bp, Artificial Sequence
  Description of Artificial Sequence: Synthetic oligonucleotide
  Target: ATXN1; (+) strand; PAM type: YTN; PAM sequence: CTG
ccgcgggtgctggcgggggc

SEQ ID NO: 311383 - DNA, 20 bp, Artificial Sequence
  Description of Artificial Sequence: Synthetic oligonucleotide
  Target: ATXN1; (+) strand; PAM type: YTN; PAM sequence: CTG
gcgggggcgccggcccggac

SEQ ID NO: 311384 - DNA, 20 bp, Artificial Sequence
  Description of Artificial Sequence: Synthetic oligonucleotide
  Target: ATXN1; (+) strand; PAM type: YTN; PAM sequence: CTG
gggcgctcgcgggctcccgg

SEQ ID NO: 311385 - DNA, 20 bp, Artificial Sequence
  Description of Artificial Sequence: Synthetic oligonucleotide
  Target: ATXN1; (+) strand; PAM type: YTN; PAM sequence: CTC
gcgggctcccggctccgggc

SEQ ID NO: 311386 - DNA, 20 bp, Artificial Sequence
  Description of Artificial Sequence: Synthetic oligonucleotide
  Target: ATXN1; (+) strand; PAM type: YTN; PAM sequence: CTC
ccggctccgggcggcggctg

SEQ ID NO: 311387 - DNA, 20 bp, Artificial Sequence
  Description of Artificial Sequence: Synthetic oligonucleotide
  Target: ATXN1; (+) strand; PAM type: YTN; PAM sequence: CTC
cgggcggcggctgccgctgc

SEQ ID NO: 311388 - DNA, 20 bp, Artificial Sequence
  Description of Artificial Sequence: Synthetic oligonucleotide
  Target: ATXN1; (+) strand; PAM type: YTN; PAM sequence: CTG
ccgctgcacatgatcaggaa

SEQ ID NO: 311389 - DNA, 20 bp, Artificial Sequence
  Description of Artificial Sequence: Synthetic oligonucleotide
  Target: ATXN1; (+) strand; PAM type: YTN; PAM sequence: CTG
cacatgatcaggaagcggcc

SEQ ID NO: 311390 - DNA, 20 bp, Artificial Sequence
  Description of Artificial Sequence: Synthetic oligonucleotide
  Target: ATXN1; (+) strand; PAM type: YTN; PAM sequence: CTC
cagccgcgctccaggcaccc

SEQ ID NO: 311391 - DNA, 20 bp, Artificial Sequence
  Description of Artificial Sequence: Synthetic oligonucleotide
  Target: ATXN1; (+) strand; PAM type: YTN; PAM sequence: CTC
caggcacccgcacacccgct

SEQ ID NO: 311392 - DNA, 20 bp, Artificial Sequence
  Description of Artificial Sequence: Synthetic oligonucleotide
  Target: ATXN1; (+) strand; PAM type: YTN; PAM sequence: CTA
cccccgcgcggtccccgagg

SEQ ID NO: 311393 - DNA, 20 bp, Artificial Sequence
  Description of Artificial Sequence: Synthetic oligonucleotide
  Target: ATXN1; (+) strand; PAM type: YTN; PAM sequence: CTC
tgcgccccccgcccggcacc

SEQ ID NO: 311394 - DNA, 20 bp, Artificial Sequence
  Description of Artificial Sequence: Synthetic oligonucleotide
  Target: ATXN1; (+) strand; PAM type: YTN; PAM sequence: CTG
cgccccccgcccggcacccg

SEQ ID NO: 311395 - DNA, 20 bp, Artificial Sequence
  Description of Artificial Sequence: Synthetic oligonucleotide
  Target: ATXN1; (+) strand; PAM type: YTN; PAM sequence: CTG
caggagcagtcccttccccg

SEQ ID NO: 311396 - DNA, 20 bp, Artificial Sequence
  Description of Artificial Sequence: Synthetic oligonucleotide
  Target: ATXN1; (+) strand; PAM type: YTN; PAM sequence: CTT
ccccgcccgcagccgcacac

SEQ ID NO: 311397 - DNA, 20 bp, Artificial Sequence
  Description of Artificial Sequence: Synthetic oligonucleotide
  Target: ATXN1; (+) strand; PAM type: YTN; PAM sequence: TTC
cccgcccgcagccgcacacc

SEQ ID NO: 311398 - DNA, 20 bp, Artificial Sequence
  Description of Artificial Sequence: Synthetic oligonucleotide
  Target: ATXN1; (+) strand; PAM type: YTN; PAM sequence: CTC
cgaggggagacccccgcccc

SEQ ID NO: 311399 - DNA, 20 bp, Artificial Sequence
  Description of Artificial Sequence: Synthetic oligonucleotide
  Target: ATXN1; (+) strand; PAM type: YTN; PAM sequence: CTC
cgtgagaccccctctctctc

SEQ ID NO: 311400 - DNA, 20 bp, Artificial Sequence
  Description of Artificial Sequence: Synthetic oligonucleotide
  Target: ATXN1; (+) strand; PAM type: YTN; PAM sequence: CTC
tctctcaccgccctctccgg

SEQ ID NO: 311401 - DNA, 20 bp, Artificial Sequence
  Description of Artificial Sequence: Synthetic oligonucleotide
  Target: ATXN1; (+) strand; PAM type: YTN; PAM sequence: CTC
tctcaccgccctctccgggg

SEQ ID NO: 311402 - DNA, 20 bp, Artificial Sequence
  Description of Artificial Sequence: Synthetic oligonucleotide
  Target: ATXN1; (+) strand; PAM type: YTN; PAM sequence: CTC
tcaccgccctctccggggag

SEQ ID NO: 311403 - DNA, 20 bp, Artificial Sequence
  Description of Artificial Sequence: Synthetic oligonucleotide
  Target: ATXN1; (+) strand; PAM type: YTN; PAM sequence: CTC
accgccctctccggggagga

SEQ ID NO: 311404 - DNA, 20 bp, Artificial Sequence
  Description of Artificial Sequence: Synthetic oligonucleotide
  Target: ATXN1; (+) strand; PAM type: YTN; PAM sequence: CTC
tccggggaggaggaatggga

SEQ ID NO: 311405 - DNA, 20 bp, Artificial Sequence
  Description of Artificial Sequence: Synthetic oligonucleotide
  Target: ATXN1; (+) strand; PAM type: YTN; PAM sequence: CTC
cggggaggaggaatgggaag

SEQ ID NO: 311406 - DNA, 20 bp, Artificial Sequence
  Description of Artificial Sequence: Synthetic oligonucleotide
  Target: ATXN1; (+) strand; PAM type: YTN; PAM sequence: CTC
ccccctgcgccacccggagg

SEQ ID NO: 311407 - DNA, 20 bp, Artificial Sequence
  Description of Artificial Sequence: Synthetic oligonucleotide
  Target: ATXN1; (+) strand; PAM type: YTN; PAM sequence: CTG
cgccacccggagggaggagg

SEQ ID NO: 311408 - DNA, 20 bp, Artificial Sequence
  Description of Artificial Sequence: Synthetic oligonucleotide
  Target: ATXN1; (+) strand; PAM type: YTN; PAM sequence: CTC
tccgcacttgcgaccggacc

SEQ ID NO: 311409 - DNA, 20 bp, Artificial Sequence
  Description of Artificial Sequence: Synthetic oligonucleotide
  Target: ATXN1; (+) strand; PAM type: YTN; PAM sequence: CTC
cgcacttgcgaccggaccag

SEQ ID NO: 311410 - DNA, 20 bp, Artificial Sequence
  Description of Artificial Sequence: Synthetic oligonucleotide
  Target: ATXN1; (+) strand; PAM type: YTN; PAM sequence: CTT
gcgaccggaccagcagccgg

SEQ ID NO: 311411 - DNA, 20 bp, Artificial Sequence
  Description of Artificial Sequence: Synthetic oligonucleotide
  Target: ATXN1; (+) strand; PAM type: YTN; PAM sequence: TTG
cgaccggaccagcagccggg

SEQ ID NO: 311412 - DNA, 20 bp, Artificial Sequence
  Description of Artificial Sequence: Synthetic oligonucleotide
  Target: ATXN1; (+) strand; PAM type: YTN; PAM sequence: CTC
tccccgcccgcgccccccgc

SEQ ID NO: 311413 - DNA, 20 bp, Artificial Sequence
  Description of Artificial Sequence: Synthetic oligonucleotide
  Target: ATXN1; (+) strand; PAM type: YTN; PAM sequence: CTC
cccgcccgcgccccccgccc

SEQ ID NO: 311414 - DNA, 20 bp, Artificial Sequence
  Description of Artificial Sequence: Synthetic oligonucleotide
  Target: ATXN1; (+) strand; PAM type: YTN; PAM sequence: CTA
gcccggcgggcgcccaccca

SEQ ID NO: 311415 - DNA, 20 bp, Artificial Sequence
  Description of Artificial Sequence: Synthetic oligonucleotide
  Target: ATXN1; (+) strand; PAM type: YTN; PAM sequence: CTG
acagcccccccgccggccgc

SEQ ID NO: 311416 - DNA, 20 bp, Artificial Sequence
  Description of Artificial Sequence: Synthetic oligonucleotide
  Target: ATXN1; (+) strand; PAM type: YTN; PAM sequence: CTG
cgcccagagtgggggtgtcg

SEQ ID NO: 311417 - DNA, 20 bp, Artificial Sequence
  Description of Artificial Sequence: Synthetic oligonucleotide
  Target: ATXN1; (+) strand; PAM type: YTN; PAM sequence: CTG
gagccggggacggttgtatg

SEQ ID NO: 311418 - DNA, 20 bp, Artificial Sequence
  Description of Artificial Sequence: Synthetic oligonucleotide
  Target: ATXN1; (+) strand; PAM type: YTN; PAM sequence: TTG
tatgtacacacatacacaca

SEQ ID NO: 311419 - DNA, 20 bp, Artificial Sequence
  Description of Artificial Sequence: Synthetic oligonucleotide
  Target: ATXN1; (+) strand; PAM type: YTN; PAM sequence: TTT
ccttcgctcctcttccagct

SEQ ID NO: 311420 - DNA, 20 bp, Artificial Sequence
  Description of Artificial Sequence: Synthetic oligonucleotide
  Target: ATXN1; (+) strand; PAM type: YTN; PAM sequence: TTC
cttcgctcctcttccagctg

SEQ ID NO: 311421 - DNA, 20 bp, Artificial Sequence
  Description of Artificial Sequence: Synthetic oligonucleotide
  Target: ATXN1; (+) strand; PAM type: YTN; PAM sequence: CTT
cgctcctcttccagctgttt

SEQ ID NO: 311422 - DNA, 20 bp, Artificial Sequence
  Description of Artificial Sequence: Synthetic oligonucleotide
  Target: ATXN1; (+) strand; PAM type: YTN; PAM sequence: TTC
gctcctcttccagctgtttt

SEQ ID NO: 311423 - DNA, 20 bp, Artificial Sequence
  Description of Artificial Sequence: Synthetic oligonucleotide
  Target: ATXN1; (+) strand; PAM type: YTN; PAM sequence: CTC
ctcttccagctgttttccgt

SEQ ID NO: 311424 - DNA, 20 bp, Artificial Sequence
  Description of Artificial Sequence: Synthetic oligonucleotide
  Target: ATXN1; (+) strand; PAM type: YTN; PAM sequence: CTC
ttccagctgttttccgtgca

SEQ ID NO: 311425 - DNA, 20 bp, Artificial Sequence
  Description of Artificial Sequence: Synthetic oligonucleotide
  Target: ATXN1; (+) strand; PAM type: YTN; PAM sequence: CTT
ccagctgttttccgtgcagc

SEQ ID NO: 311426 - DNA, 20 bp, Artificial Sequence
  Description of Artificial Sequence: Synthetic oligonucleotide
  Target: ATXN1; (+) strand; PAM type: YTN; PAM sequence: TTC
cagctgttttccgtgcagcc

SEQ ID NO: 311427 - DNA, 20 bp, Artificial Sequence
  Description of Artificial Sequence: Synthetic oligonucleotide
  Target: ATXN1; (+) strand; PAM type: YTN; PAM sequence: CTG
ttttccgtgcagccgattgg

SEQ ID NO: 311428 - DNA, 20 bp, Artificial Sequence
  Description of Artificial Sequence: Synthetic oligonucleotide
  Target: ATXN1; (+) strand; PAM type: YTN; PAM sequence: TTT
tccgtgcagccgattggggt

SEQ ID NO: 311429 - DNA, 20 bp, Artificial Sequence
  Description of Artificial Sequence: Synthetic oligonucleotide
  Target: ATXN1; (+) strand; PAM type: YTN; PAM sequence: TTT
ccgtgcagccgattggggtt

SEQ ID NO: 311430 - DNA, 20 bp, Artificial Sequence
  Description of Artificial Sequence: Synthetic oligonucleotide
  Target: ATXN1; (+) strand; PAM type: YTN; PAM sequence: TTC
cgtgcagccgattggggttt

SEQ ID NO: 311431 - DNA, 20 bp, Artificial Sequence
  Description of Artificial Sequence: Synthetic oligonucleotide
  Target: ATXN1; (+) strand; PAM type: YTN; PAM sequence: TTG
gggttttgggtttgtttgct

SEQ ID NO: 311432 - DNA, 20 bp, Artificial Sequence
  Description of Artificial Sequence: Synthetic oligonucleotide
  Target: ATXN1; (+) strand; PAM type: YTN; PAM sequence: TTT
tgggtttgtttgctggttgt

SEQ ID NO: 311433 - DNA, 20 bp, Artificial Sequence
  Description of Artificial Sequence: Synthetic oligonucleotide
  Target: ATXN1; (+) strand; PAM type: YTN; PAM sequence: TTT
gggtttgtttgctggttgtt

SEQ ID NO: 311434 - DNA, 20 bp, Artificial Sequence
  Description of Artificial Sequence: Synthetic oligonucleotide
  Target: ATXN1; (+) strand; PAM type: YTN; PAM sequence: TTG
ggtttgtttgctggttgttg

SEQ ID NO: 311435 - DNA, 20 bp, Artificial Sequence
  Description of Artificial Sequence: Synthetic oligonucleotide
  Target: ATXN1; (+) strand; PAM type: YTN; PAM sequence: TTT
gtttgctggttgttgctttt

SEQ ID NO: 311436 - DNA, 20 bp, Artificial Sequence
  Description of Artificial Sequence: Synthetic oligonucleotide
  Target: ATXN1; (+) strand; PAM type: YTN; PAM sequence: TTG
tttgctggttgttgcttttg

SEQ ID NO: 311437 - DNA, 20 bp, Artificial Sequence
  Description of Artificial Sequence: Synthetic oligonucleotide
  Target: ATXN1; (+) strand; PAM type: YTN; PAM sequence: TTT
gctggttgttgcttttgccc

SEQ ID NO: 311438 - DNA, 20 bp, Artificial Sequence
  Description of Artificial Sequence: Synthetic oligonucleotide
  Target: ATXN1; (+) strand; PAM type: YTN; PAM sequence: TTG
ctggttgttgcttttgcccc

SEQ ID NO: 311439 - DNA, 20 bp, Artificial Sequence
  Description of Artificial Sequence: Synthetic oligonucleotide
  Target: ATXN1; (+) strand; PAM type: YTN; PAM sequence: CTG
gttgttgcttttgcccctct

SEQ ID NO: 311440 - DNA, 20 bp, Artificial Sequence
  Description of Artificial Sequence: Synthetic oligonucleotide
  Target: ATXN1; (+) strand; PAM type: YTN; PAM sequence: TTG
ttgcttttgcccctctcggg

SEQ ID NO: 311441 - DNA, 20 bp, Artificial Sequence
  Description of Artificial Sequence: Synthetic oligonucleotide
  Target: ATXN1; (+) strand; PAM type: YTN; PAM sequence: TTG
cttttgcccctctcgggaga

SEQ ID NO: 311442 - DNA, 20 bp, Artificial Sequence
  Description of Artificial Sequence: Synthetic oligonucleotide
  Target: ATXN1; (+) strand; PAM type: YTN; PAM sequence: CTT
ttgcccctctcgggagatcg

SEQ ID NO: 311443 - DNA, 20 bp, Artificial Sequence
  Description of Artificial Sequence: Synthetic oligonucleotide
  Target: ATXN1; (+) strand; PAM type: YTN; PAM sequence: TTT
tgcccctctcgggagatcgg

SEQ ID NO: 311444 - DNA, 20 bp, Artificial Sequence
  Description of Artificial Sequence: Synthetic oligonucleotide
  Target: ATXN1; (+) strand; PAM type: YTN; PAM sequence: TTT
gcccctctcgggagatcggg

SEQ ID NO: 311445 - DNA, 20 bp, Artificial Sequence
  Description of Artificial Sequence: Synthetic oligonucleotide
  Target: ATXN1; (+) strand; PAM type: YTN; PAM sequence: TTG
cccctctcgggagatcgggg

SEQ ID NO: 311446 - DNA, 20 bp, Artificial Sequence
  Description of Artificial Sequence: Synthetic oligonucleotide
  Target: ATXN1; (+) strand; PAM type: YTN; PAM sequence: CTC
tcgggagatcgggggaggag

SEQ ID NO: 311447 - DNA, 20 bp, Artificial Sequence
  Description of Artificial Sequence: Synthetic oligonucleotide
  Target: ATXN1; (+) strand; PAM type: YTN; PAM sequence: CTC
gggagatcgggggaggaggg

SEQ ID NO: 311448 - DNA, 20 bp, Artificial Sequence
  Description of Artificial Sequence: Synthetic oligonucleotide
  Target: ATXN1; (+) strand; PAM type: YTN; PAM sequence: TTT
taatctaaataaggggagaa

SEQ ID NO: 311449 - DNA, 20 bp, Artificial Sequence
  Description of Artificial Sequence: Synthetic oligonucleotide
  Target: ATXN1; (+) strand; PAM type: YTN; PAM sequence: TTT
aatctaaataaggggagaag

SEQ ID NO: 311450 - DNA, 20 bp, Artificial Sequence
  Description of Artificial Sequence: Synthetic oligonucleotide
  Target: ATXN1; (+) strand; PAM type: YTN; PAM sequence: TTA
atctaaataaggggagaagg

SEQ ID NO: 311451 - DNA, 20 bp, Artificial Sequence
  Description of Artificial Sequence: Synthetic oligonucleotide
  Target: ATXN1; (+) strand; PAM type: YTN; PAM sequence: CTA
aataaggggagaagggaatg

SEQ ID NO: 311452 - DNA, 20 bp, Artificial Sequence
  Description of Artificial Sequence: Synthetic oligonucleotide
  Target: ATXN1; (+) strand; PAM type: YTN; PAM sequence: CTT
actgtaaagtgtaaatggat

SEQ ID NO: 311453 - DNA, 20 bp, Artificial Sequence
  Description of Artificial Sequence: Synthetic oligonucleotide
  Target: ATXN1; (+) strand; PAM type: YTN; PAM sequence: TTA
ctgtaaagtgtaaatggatc

SEQ ID NO: 311454 - DNA, 20 bp, Artificial Sequence
  Description of Artificial Sequence: Synthetic oligonucleotide
  Target: ATXN1; (+) strand; PAM type: YTN; PAM sequence: CTG
taaagtgtaaatggatctgg

SEQ ID NO: 311455 - DNA, 20 bp, Artificial Sequence
  Description of Artificial Sequence: Synthetic oligonucleotide
  Target: ATXN1; (+) strand; PAM type: YTN; PAM sequence: CTG
gggttgcgtggggaaggggg

SEQ ID NO: 311456 - DNA, 20 bp, Artificial Sequence
  Description of Artificial Sequence: Synthetic oligonucleotide
  Target: ATXN1; (+) strand; PAM type: YTN; PAM sequence: TTG
cgtggggaagggggggcaga

SEQ ID NO: 311457 - DNA, 20 bp, Artificial Sequence
  Description of Artificial Sequence: Synthetic oligonucleotide
  Target: ATXN1; (+) strand; PAM type: YTN; PAM sequence: CTT
gcggctgctgttgctctggc

SEQ ID NO: 311458 - DNA, 20 bp, Artificial Sequence
  Description of Artificial Sequence: Synthetic oligonucleotide
  Target: ATXN1; (+) strand; PAM type: YTN; PAM sequence: TTG
cggctgctgttgctctggct

SEQ ID NO: 311459 - DNA, 20 bp, Artificial Sequence
  Description of Artificial Sequence: Synthetic oligonucleotide
  Target: ATXN1; (+) strand; PAM type: YTN; PAM sequence: CTG
ctgttgctctggctgctgct

SEQ ID NO: 311460 - DNA, 20 bp, Artificial Sequence
  Description of Artificial Sequence: Synthetic oligonucleotide
  Target: ATXN1; (+) strand; PAM type: YTN; PAM sequence: CTG
ttgctctggctgctgctcca

SEQ ID NO: 311461 - DNA, 20 bp, Artificial Sequence
  Description of Artificial Sequence: Synthetic oligonucleotide
  Target: ATXN1; (+) strand; PAM type: YTN; PAM sequence: TTG
ctctggctgctgctccacgg

SEQ ID NO: 311462 - DNA, 20 bp, Artificial Sequence
  Description of Artificial Sequence: Synthetic oligonucleotide
  Target: ATXN1; (+) strand; PAM type: YTN; PAM sequence: CTC
tggctgctgctccacggggc

SEQ ID NO: 311463 - DNA, 20 bp, Artificial Sequence
  Description of Artificial Sequence: Synthetic oligonucleotide
  Target: ATXN1; (+) strand; PAM type: YTN; PAM sequence: CTG
gctgctgctccacggggctt

SEQ ID NO: 311464 - DNA, 20 bp, Artificial Sequence
  Description of Artificial Sequence: Synthetic oligonucleotide
  Target: ATXN1; (+) strand; PAM type: YTN; PAM sequence: CTG
ctgctccacggggcttgttt

SEQ ID NO: 311465 - DNA, 20 bp, Artificial Sequence
  Description of Artificial Sequence: Synthetic oligonucleotide
  Target: ATXN1; (+) strand; PAM type: YTN; PAM sequence: CTG
ctccacggggcttgttttgg

SEQ ID NO: 311466 - DNA, 20 bp, Artificial Sequence
  Description of Artificial Sequence: Synthetic oligonucleotide
  Target: ATXN1; (+) strand; PAM type: YTN; PAM sequence: CTC
cacggggcttgttttggatc

SEQ ID NO: 311467 - DNA, 20 bp, Artificial Sequence
  Description of Artificial Sequence: Synthetic oligonucleotide
  Target: ATXN1; (+) strand; PAM type: YTN; PAM sequence: CTT
gttttggatccccctgcagt

SEQ ID NO: 311468 - DNA, 20 bp, Artificial Sequence
  Description of Artificial Sequence: Synthetic oligonucleotide
  Target: ATXN1; (+) strand; PAM type: YTN; PAM sequence: TTG
ttttggatccccctgcagtg

SEQ ID NO: 311469 - DNA, 20 bp, Artificial Sequence
  Description of Artificial Sequence: Synthetic oligonucleotide
  Target: ATXN1; (+) strand; PAM type: YTN; PAM sequence: TTT
tggatccccctgcagtgaaa

SEQ ID NO: 311470 - DNA, 20 bp, Artificial Sequence
  Description of Artificial Sequence: Synthetic oligonucleotide
  Target: ATXN1; (+) strand; PAM type: YTN; PAM sequence: TTT
ggatccccctgcagtgaaac

SEQ ID NO: 311471 - DNA, 20 bp, Artificial Sequence
  Description of Artificial Sequence: Synthetic oligonucleotide
  Target: ATXN1; (+) strand; PAM type: YTN; PAM sequence: TTG
gatccccctgcagtgaaaca

SEQ ID NO: 311472 - DNA, 20 bp, Artificial Sequence
  Description of Artificial Sequence: Synthetic oligonucleotide
  Target: ATXN1; (+) strand; PAM type: YTN; PAM sequence: CTG
cagtgaaacaggtcctgtac

SEQ ID NO: 311473 - DNA, 20 bp, Artificial Sequence
  Description of Artificial Sequence: Synthetic oligonucleotide
  Target: ATXN1; (+) strand; PAM type: YTN; PAM sequence: CTG
tacggctccgccactgtagt

SEQ ID NO: 311474 - DNA, 20 bp, Artificial Sequence
  Description of Artificial Sequence: Synthetic oligonucleotide
  Target: ATXN1; (+) strand; PAM type: YTN; PAM sequence: CTC
cgccactgtagtagaaatga

SEQ ID NO: 311475 - DNA, 20 bp, Artificial Sequence
  Description of Artificial Sequence: Synthetic oligonucleotide
  Target: ATXN1; (+) strand; PAM type: YTN; PAM sequence: CTG
tagtagaaatgatgtctgcg

SEQ ID NO: 311476 - DNA, 20 bp, Artificial Sequence
  Description of Artificial Sequence: Synthetic oligonucleotide
  Target: ATXN1; (+) strand; PAM type: YTN; PAM sequence: CTG
cggtatactctgctctctcc

SEQ ID NO: 311477 - DNA, 20 bp, Artificial Sequence
  Description of Artificial Sequence: Synthetic oligonucleotide
  Target: ATXN1; (+) strand; PAM type: YTN; PAM sequence: CTC
tgctctctcctcctcctcct

SEQ ID NO: 311478 - DNA, 20 bp, Artificial Sequence
  Description of Artificial Sequence: Synthetic oligonucleotide
  Target: ATXN1; (+) strand; PAM type: YTN; PAM sequence: CTG
ctctctcctcctcctcctcc

SEQ ID NO: 311479 - DNA, 20 bp, Artificial Sequence
  Description of Artificial Sequence: Synthetic oligonucleotide
  Target: ATXN1; (+) strand; PAM type: YTN; PAM sequence: CTC
tctcctcctcctcctcctcc

SEQ ID NO: 311480 - DNA, 20 bp, Artificial Sequence
  Description of Artificial Sequence: Synthetic oligonucleotide
  Target: ATXN1; (+) strand; PAM type: YTN; PAM sequence: CTC
tcctcctcctcctcctcctc

SEQ ID NO: 311481 - DNA, 20 bp, Artificial Sequence
  Description of Artificial Sequence: Synthetic oligonucleotide
  Target: ATXN1; (+) strand; PAM type: YTN; PAM sequence: CTC
ctcctcctcctcctcctcct

SEQ ID NO: 311482 - DNA, 20 bp, Artificial Sequence
  Description of Artificial Sequence: Synthetic oligonucleotide
  Target: ATXN1; (+) strand; PAM type: YTN; PAM sequence: CTC
ctcctcctcctcctcctcct

SEQ ID NO: 311483 - DNA, 20 bp, Artificial Sequence
  Description of Artificial Sequence: Synthetic oligonucleotide
  Target: ATXN1; (+) strand; PAM type: YTN; PAM sequence: CTC
ctcctcctcctcctcctccc

SEQ ID NO: 311484 - DNA, 20 bp, Artificial Sequence
  Description of Artificial Sequence: Synthetic oligonucleotide
  Target: ATXN1; (+) strand; PAM type: YTN; PAM sequence: CTC
ctcctcctcctcctccccct

SEQ ID NO: 311485 - DNA, 20 bp, Artificial Sequence
  Description of Artificial Sequence: Synthetic oligonucleotide
  Target: ATXN1; (+) strand; PAM type: YTN; PAM sequence: CTC
ctcctcctcctccccctcct

SEQ ID NO: 311486 - DNA, 20 bp, Artificial Sequence
  Description of Artificial Sequence: Synthetic oligonucleotide
  Target: ATXN1; (+) strand; PAM type: YTN; PAM sequence: CTC
ctcctcctccccctcctccc

SEQ ID NO: 311487 - DNA, 20 bp, Artificial Sequence
  Description of Artificial Sequence: Synthetic oligonucleotide
  Target: ATXN1; (+) strand; PAM type: YTN; PAM sequence: CTC
ctcctccccctcctcccgct

SEQ ID NO: 311488 - DNA, 20 bp, Artificial Sequence
  Description of Artificial Sequence: Synthetic oligonucleotide
  Target: ATXN1; (+) strand; PAM type: YTN; PAM sequence: CTC
ctccccctcctcccgctccc

SEQ ID NO: 311489 - DNA, 20 bp, Artificial Sequence
  Description of Artificial Sequence: Synthetic oligonucleotide
  Target: ATXN1; (+) strand; PAM type: YTN; PAM sequence: CTC
cccctcctcccgctcccctc

SEQ ID NO: 311490 - DNA, 20 bp, Artificial Sequence
  Description of Artificial Sequence: Synthetic oligonucleotide
  Target: ATXN1; (+) strand; PAM type: YTN; PAM sequence: CTC
ctcccgctcccctcccctcc

SEQ ID NO: 311491 - DNA, 20 bp, Artificial Sequence
  Description of Artificial Sequence: Synthetic oligonucleotide
  Target: ATXN1; (+) strand; PAM type: YTN; PAM sequence: CTC
ccgctcccctcccctccctc

SEQ ID NO: 311492 - DNA, 20 bp, Artificial Sequence
  Description of Artificial Sequence: Synthetic oligonucleotide
  Target: ATXN1; (+) strand; PAM type: YTN; PAM sequence: CTC
ccctcccctccctcctccct

SEQ ID NO: 311493 - DNA, 20 bp, Artificial Sequence
  Description of Artificial Sequence: Synthetic oligonucleotide
  Target: ATXN1; (+) strand; PAM type: YTN; PAM sequence: CTC
ccctccctcctccctccgcc

SEQ ID NO: 311494 - DNA, 20 bp, Artificial Sequence
  Description of Artificial Sequence: Synthetic oligonucleotide
  Target: ATXN1; (+) strand; PAM type: YTN; PAM sequence: CTC
cctcctccctccgcccgccc

SEQ ID NO: 311495 - DNA, 20 bp, Artificial Sequence
  Description of Artificial Sequence: Synthetic oligonucleotide
  Target: ATXN1; (+) strand; PAM type: YTN; PAM sequence: CTC
ctccctccgcccgcccgccc

SEQ ID NO: 311496 - DNA, 20 bp, Artificial Sequence
  Description of Artificial Sequence: Synthetic oligonucleotide
  Target: ATXN1; (+) strand; PAM type: YTN; PAM sequence: CTC
cctccgcccgcccgccctcc

SEQ ID NO: 311497 - DNA, 20 bp, Artificial Sequence
  Description of Artificial Sequence: Synthetic oligonucleotide
  Target: ATXN1; (+) strand; PAM type: YTN; PAM sequence: CTC
cgcccgcccgccctccctcc

SEQ ID NO: 311498 - DNA, 20 bp, Artificial Sequence
  Description of Artificial Sequence: Synthetic oligonucleotide
  Target: ATXN1; (+) strand; PAM type: YTN; PAM sequence: CTC
cctccctccctcgcgctctc

SEQ ID NO: 311499 - DNA, 20 bp, Artificial Sequence
  Description of Artificial Sequence: Synthetic oligonucleotide
  Target: ATXN1; (+) strand; PAM type: YTN; PAM sequence: CTC
cctccctcgcgctctctcgc

SEQ ID NO: 311500 - DNA, 20 bp, Artificial Sequence
  Description of Artificial Sequence: Synthetic oligonucleotide
  Target: ATXN1; (+) strand; PAM type: YTN; PAM sequence: CTC
cctcgcgctctctcgcgctc

SEQ ID NO: 311501 - DNA, 20 bp, Artificial Sequence
  Description of Artificial Sequence: Synthetic oligonucleotide
  Target: ATXN1; (+) strand; PAM type: YTN; PAM sequence: CTC
gcgctctctcgcgctcgctc

SEQ ID NO: 311502 - DNA, 20 bp, Artificial Sequence
  Description of Artificial Sequence: Synthetic oligonucleotide
  Target: ATXN1; (+) strand; PAM type: YTN; PAM sequence: CTC
tctcgcgctcgctcgctcgc

SEQ ID NO: 311503 - DNA, 20 bp, Artificial Sequence
  Description of Artificial Sequence: Synthetic oligonucleotide
  Target: ATXN1; (+) strand; PAM type: YTN; PAM sequence: CTC
tcgcgctcgctcgctcgctc

SEQ ID NO: 311504 - DNA, 20 bp, Artificial Sequence
  Description of Artificial Sequence: Synthetic oligonucleotide
  Target: ATXN1; (+) strand; PAM type: YTN; PAM sequence: CTC
gcgctcgctcgctcgctcgc

SEQ ID NO: 311505 - DNA, 20 bp, Artificial Sequence
  Description of Artificial Sequence: Synthetic oligonucleotide
  Target: ATXN1; (+) strand; PAM type: YTN; PAM sequence: CTC
gctcgctcgctcgctccagt

SEQ ID NO: 311506 - DNA, 20 bp, Artificial Sequence
  Description of Artificial Sequence: Synthetic oligonucleotide
  Target: ATXN1; (+) strand; PAM type: YTN; PAM sequence: CTC
gctcgctcgctccagtatgt

SEQ ID NO: 311507 - DNA, 20 bp, Artificial Sequence
  Description of Artificial Sequence: Synthetic oligonucleotide
  Target: ATXN1; (+) strand; PAM type: YTN; PAM sequence: CTC
gctcgctccagtatgtaaat

SEQ ID NO: 311508 - DNA, 20 bp, Artificial Sequence
  Description of Artificial Sequence: Synthetic oligonucleotide
  Target: ATXN1; (+) strand; PAM type: YTN; PAM sequence: CTC
gctccagtatgtaaatgtgt

SEQ ID NO: 311509 - DNA, 20 bp, Artificial Sequence
  Description of Artificial Sequence: Synthetic oligonucleotide
  Target: ATXN1; (+) strand; PAM type: YTN; PAM sequence: CTC
cagtatgtaaatgtgtaata

SEQ ID NO: 311510 - DNA, 20 bp, Artificial Sequence
  Description of Artificial Sequence: Synthetic oligonucleotide
  Target: ATXN1; (+) strand; PAM type: YTN; PAM sequence: TTG
gctgccgccgccgcagctca

SEQ ID NO: 311511 - DNA, 20 bp, Artificial Sequence
  Description of Artificial Sequence: Synthetic oligonucleotide
  Target: ATXN1; (+) strand; PAM type: YTN; PAM sequence: CTG
ccgccgccgcagctcaagga

SEQ ID NO: 311512 - DNA, 20 bp, Artificial Sequence
  Description of Artificial Sequence: Synthetic oligonucleotide
  Target: ATXN1; (+) strand; PAM type: YTN; PAM sequence: CTC
aaggatccgacttcatgggg

SEQ ID NO: 311513 - DNA, 20 bp, Artificial Sequence
  Description of Artificial Sequence: Synthetic oligonucleotide
  Target: ATXN1; (+) strand; PAM type: YTN; PAM sequence: CTT
catgggggtggggggcaccc

SEQ ID NO: 311514 - DNA, 20 bp, Artificial Sequence
  Description of Artificial Sequence: Synthetic oligonucleotide
  Target: ATXN1; (+) strand; PAM type: YTN; PAM sequence: TTC
atgggggtggggggcaccct

SEQ ID NO: 311515 - DNA, 20 bp, Artificial Sequence
  Description of Artificial Sequence: Synthetic oligonucleotide
  Target: ATXN1; (+) strand; PAM type: YTN; PAM sequence: CTC
tggcgggcggcccggcgagc

SEQ ID NO: 311516 - DNA, 20 bp, Artificial Sequence
  Description of Artificial Sequence: Synthetic oligonucleotide
  Target: ATXN1; (+) strand; PAM type: YTN; PAM sequence: CTG
gcgggcggcccggcgagccg

SEQ ID NO: 311517 - DNA, 20 bp, Artificial Sequence
  Description of Artificial Sequence: Synthetic oligonucleotide
  Target: ATXN1; (+) strand; PAM type: YTN; PAM sequence: CTT
aacccttcgctgcgcgccgc

SEQ ID NO: 311518 - DNA, 20 bp, Artificial Sequence
  Description of Artificial Sequence: Synthetic oligonucleotide
  Target: ATXN1; (+) strand; PAM type: YTN; PAM sequence: TTA
acccttcgctgcgcgccgcc

SEQ ID NO: 311519 - DNA, 20 bp, Artificial Sequence
  Description of Artificial Sequence: Synthetic oligonucleotide
  Target: ATXN1; (+) strand; PAM type: YTN; PAM sequence: CTT
cgctgcgcgccgcccgggga

SEQ ID NO: 311520 - DNA, 20 bp, Artificial Sequence
  Description of Artificial Sequence: Synthetic oligonucleotide
  Target: ATXN1; (+) strand; PAM type: YTN; PAM sequence: TTC
gctgcgcgccgcccggggag

SEQ ID NO: 311521 - DNA, 20 bp, Artificial Sequence
  Description of Artificial Sequence: Synthetic oligonucleotide
  Target: ATXN1; (+) strand; PAM type: YTN; PAM sequence: CTG
cgcgccgcccggggaggcgg

SEQ ID NO: 311522 - DNA, 20 bp, Artificial Sequence
  Description of Artificial Sequence: Synthetic oligonucleotide
  Target: ATXN1; (+) strand; PAM type: YTN; PAM sequence: CTT
tcccaaagagtggctcggga

SEQ ID NO: 311523 - DNA, 20 bp, Artificial Sequence
  Description of Artificial Sequence: Synthetic oligonucleotide
  Target: ATXN1; (+) strand; PAM type: YTN; PAM sequence: TTT
cccaaagagtggctcgggat

SEQ ID NO: 311524 - DNA, 20 bp, Artificial Sequence
  Description of Artificial Sequence: Synthetic oligonucleotide
  Target: ATXN1; (+) strand; PAM type: YTN; PAM sequence: TTC
ccaaagagtggctcgggatg

SEQ ID NO: 311525 - DNA, 20 bp, Artificial Sequence
  Description of Artificial Sequence: Synthetic oligonucleotide
  Target: ATXN1; (+) strand; PAM type: YTN; PAM sequence: CTC
gggatggggtgcgggggagg

SEQ ID NO: 311526 - DNA, 20 bp, Artificial Sequence
  Description of Artificial Sequence: Synthetic oligonucleotide
  Target: ATXN1; (+) strand; PAM type: YTN; PAM sequence: TTC
cttccaggtttgggaagggg

SEQ ID NO: 311527 - DNA, 20 bp, Artificial Sequence
  Description of Artificial Sequence: Synthetic oligonucleotide
  Target: ATXN1; (+) strand; PAM type: YTN; PAM sequence: CTT
ccaggtttgggaagggggcg

SEQ ID NO: 311528 - DNA, 20 bp, Artificial Sequence
  Description of Artificial Sequence: Synthetic oligonucleotide
  Target: ATXN1; (+) strand; PAM type: YTN; PAM sequence: TTC
caggtttgggaagggggcgg

SEQ ID NO: 311529 - DNA, 20 bp, Artificial Sequence
  Description of Artificial Sequence: Synthetic oligonucleotide
  Target: ATXN1; (+) strand; PAM type: YTN; PAM sequence: TTT
gggaagggggcggggagctg

SEQ ID NO: 311530 - DNA, 20 bp, Artificial Sequence
  Description of Artificial Sequence: Synthetic oligonucleotide
  Target: ATXN1; (+) strand; PAM type: YTN; PAM sequence: TTG
ggaagggggcggggagctgg

SEQ ID NO: 311531 - DNA, 20 bp, Artificial Sequence
  Description of Artificial Sequence: Synthetic oligonucleotide
  Target: ATXN1; (+) strand; PAM type: YTN; PAM sequence: CTG
ggcgatgaggtaatttgagc

SEQ ID NO: 311532 - DNA, 20 bp, Artificial Sequence
  Description of Artificial Sequence: Synthetic oligonucleotide
  Target: ATXN1; (+) strand; PAM type: YTN; PAM sequence: TTT
gagcggtgacgggtcggtcc

SEQ ID NO: 311533 - DNA, 20 bp, Artificial Sequence
  Description of Artificial Sequence: Synthetic oligonucleotide
  Target: ATXN1; (+) strand; PAM type: YTN; PAM sequence: TTG
agcggtgacgggtcggtcct

SEQ ID NO: 311534 - DNA, 20 bp, Artificial Sequence
  Description of Artificial Sequence: Synthetic oligonucleotide
  Target: ATXN1; (+) strand; PAM type: YTN; PAM sequence: CTC
gcgcgcctccctgggtccct

SEQ ID NO: 311535 - DNA, 20 bp, Artificial Sequence
  Description of Artificial Sequence: Synthetic oligonucleotide
  Target: ATXN1; (+) strand; PAM type: YTN; PAM sequence: CTC
cctgggtccctgcacctagt

SEQ ID NO: 311536 - DNA, 20 bp, Artificial Sequence
  Description of Artificial Sequence: Synthetic oligonucleotide
  Target: ATXN1; (+) strand; PAM type: YTN; PAM sequence: CTG
ggtccctgcacctagttgga

SEQ ID NO: 311537 - DNA, 20 bp, Artificial Sequence
  Description of Artificial Sequence: Synthetic oligonucleotide
  Target: ATXN1; (+) strand; PAM type: YTN; PAM sequence: CTG
cacctagttggaggggactg

SEQ ID NO: 311538 - DNA, 20 bp, Artificial Sequence
  Description of Artificial Sequence: Synthetic oligonucleotide
  Target: ATXN1; (+) strand; PAM type: YTN; PAM sequence: CTA
gttggaggggactgaacgac

SEQ ID NO: 311539 - DNA, 20 bp, Artificial Sequence
  Description of Artificial Sequence: Synthetic oligonucleotide
  Target: ATXN1; (+) strand; PAM type: YTN; PAM sequence: TTG
gaggggactgaacgacaacg

SEQ ID NO: 311540 - DNA, 20 bp, Artificial Sequence
  Description of Artificial Sequence: Synthetic oligonucleotide
  Target: ATXN1; (+) strand; PAM type: YTN; PAM sequence: CTG
aacgacaacggggcgctact

SEQ ID NO: 311541 - DNA, 20 bp, Artificial Sequence
  Description of Artificial Sequence: Synthetic oligonucleotide
  Target: ATXN1; (+) strand; PAM type: YTN; PAM sequence: CTA
ctcaggcaacctgggggact

SEQ ID NO: 311542 - DNA, 20 bp, Artificial Sequence
  Description of Artificial Sequence: Synthetic oligonucleotide
  Target: ATXN1; (+) strand; PAM type: YTN; PAM sequence: CTC
aggcaacctgggggactccc

SEQ ID NO: 311543 - DNA, 20 bp, Artificial Sequence
  Description of Artificial Sequence: Synthetic oligonucleotide
  Target: ATXN1; (+) strand; PAM type: YTN; PAM sequence: CTG
ggggactcccccaagggctg

SEQ ID NO: 311544 - DNA, 20 bp, Artificial Sequence
  Description of Artificial Sequence: Synthetic oligonucleotide
  Target: ATXN1; (+) strand; PAM type: YTN; PAM sequence: CTC
ccccaagggctgtcaggctt

SEQ ID NO: 311545 - DNA, 20 bp, Artificial Sequence
  Description of Artificial Sequence: Synthetic oligonucleotide
  Target: ATXN1; (+) strand; PAM type: YTN; PAM sequence: CTG
tcaggcttcagctgggagcc

SEQ ID NO: 311546 - DNA, 20 bp, Artificial Sequence
  Description of Artificial Sequence: Synthetic oligonucleotide
  Target: ATXN1; (+) strand; PAM type: YTN; PAM sequence: CTT
cagctgggagccgatgcaac

SEQ ID NO: 311547 - DNA, 20 bp, Artificial Sequence
  Description of Artificial Sequence: Synthetic oligonucleotide
  Target: ATXN1; (+) strand; PAM type: YTN; PAM sequence: TTC
agctgggagccgatgcaaca

SEQ ID NO: 311548 - DNA, 20 bp, Artificial Sequence
  Description of Artificial Sequence: Synthetic oligonucleotide
  Target: ATXN1; (+) strand; PAM type: YTN; PAM sequence: CTG
ggagccgatgcaacacccca

SEQ ID NO: 311549 - DNA, 20 bp, Artificial Sequence
  Description of Artificial Sequence: Synthetic oligonucleotide
  Target: ATXN1; (+) strand; PAM type: YTN; PAM sequence: TTC
taatcccgacgtgtccttgg

SEQ ID NO: 311550 - DNA, 20 bp, Artificial Sequence
  Description of Artificial Sequence: Synthetic oligonucleotide
  Target: ATXN1; (+) strand; PAM type: YTN; PAM sequence: CTA
atcccgacgtgtccttggtc

SEQ ID NO: 311551 - DNA, 20 bp, Artificial Sequence
  Description of Artificial Sequence: Synthetic oligonucleotide
  Target: ATXN1; (+) strand; PAM type: YTN; PAM sequence: CTT
ggtcccaggcgctcggagca

SEQ ID NO: 311552 - DNA, 20 bp, Artificial Sequence
  Description of Artificial Sequence: Synthetic oligonucleotide
  Target: ATXN1; (+) strand; PAM type: YTN; PAM sequence: TTG
gtcccaggcgctcggagcag

SEQ ID NO: 311553 - DNA, 20 bp, Artificial Sequence
  Description of Artificial Sequence: Synthetic oligonucleotide
  Target: ATXN1; (+) strand; PAM type: YTN; PAM sequence: CTC
ggagcagcatctgagagggc

SEQ ID NO: 311554 - DNA, 20 bp, Artificial Sequence
  Description of Artificial Sequence: Synthetic oligonucleotide
  Target: ATXN1; (+) strand; PAM type: YTN; PAM sequence: CTG
agagggctcactctgatcat

SEQ ID NO: 311555 - DNA, 20 bp, Artificial Sequence
  Description of Artificial Sequence: Synthetic oligonucleotide
  Target: ATXN1; (+) strand; PAM type: YTN; PAM sequence: CTC
actctgatcatcagctgcac

SEQ ID NO: 311556 - DNA, 20 bp, Artificial Sequence
  Description of Artificial Sequence: Synthetic oligonucleotide
  Target: ATXN1; (+) strand; PAM type: YTN; PAM sequence: CTC
tgatcatcagctgcacgtta

SEQ ID NO: 311557 - DNA, 20 bp, Artificial Sequence
  Description of Artificial Sequence: Synthetic oligonucleotide
  Target: ATXN1; (+) strand; PAM type: YTN; PAM sequence: CTG
atcatcagctgcacgttaag

SEQ ID NO: 311558 - DNA, 20 bp, Artificial Sequence
  Description of Artificial Sequence: Synthetic oligonucleotide
  Target: ATXN1; (+) strand; PAM type: YTN; PAM sequence: CTG
cacgttaagccacaaaccgg

SEQ ID NO: 311559 - DNA, 20 bp, Artificial Sequence
  Description of Artificial Sequence: Synthetic oligonucleotide
  Target: ATXN1; (+) strand; PAM type: YTN; PAM sequence: TTA
agccacaaaccggcgtcgct

SEQ ID NO: 311560 - DNA, 20 bp, Artificial Sequence
  Description of Artificial Sequence: Synthetic oligonucleotide
  Target: ATXN1; (+) strand; PAM type: YTN; PAM sequence: CTT
cggcgttccggaacccaggc

SEQ ID NO: 311561 - DNA, 20 bp, Artificial Sequence
  Description of Artificial Sequence: Synthetic oligonucleotide
  Target: ATXN1; (+) strand; PAM type: YTN; PAM sequence: TTC
ggcgttccggaacccaggcc

SEQ ID NO: 311562 - DNA, 20 bp, Artificial Sequence
  Description of Artificial Sequence: Synthetic oligonucleotide
  Target: ATXN1; (+) strand; PAM type: YTN; PAM sequence: TTC
cggaacccaggcctgggggc

SEQ ID NO: 311563 - DNA, 20 bp, Artificial Sequence
  Description of Artificial Sequence: Synthetic oligonucleotide
  Target: ATXN1; (+) strand; PAM type: YTN; PAM sequence: CTG
ggggccgcggggattgcctc

SEQ ID NO: 311564 - DNA, 20 bp, Artificial Sequence
  Description of Artificial Sequence: Synthetic oligonucleotide
  Target: ATXN1; (+) strand; PAM type: YTN; PAM sequence: TTG
cctctgcgtgcaactccgga

SEQ ID NO: 311565 - DNA, 20 bp, Artificial Sequence
  Description of Artificial Sequence: Synthetic oligonucleotide
  Target: ATXN1; (+) strand; PAM type: YTN; PAM sequence: CTC
tgcgtgcaactccggaaagt

SEQ ID NO: 311566 - DNA, 20 bp, Artificial Sequence
  Description of Artificial Sequence: Synthetic oligonucleotide
  Target: ATXN1; (+) strand; PAM type: YTN; PAM sequence: CTG
cgtgcaactccggaaagttt

SEQ ID NO: 311567 - DNA, 20 bp, Artificial Sequence
  Description of Artificial Sequence: Synthetic oligonucleotide
  Target: ATXN1; (+) strand; PAM type: YTN; PAM sequence: CTC
cggaaagtttcaaggggtcc

SEQ ID NO: 311568 - DNA, 20 bp, Artificial Sequence
  Description of Artificial Sequence: Synthetic oligonucleotide
  Target: ATXN1; (+) strand; PAM type: YTN; PAM sequence: TTT
caaggggtcccccgactgca

SEQ ID NO: 311569 - DNA, 20 bp, Artificial Sequence
  Description of Artificial Sequence: Synthetic oligonucleotide
  Target: ATXN1; (+) strand; PAM type: YTN; PAM sequence: TTC
aaggggtcccccgactgcac

SEQ ID NO: 311570 - DNA, 20 bp, Artificial Sequence
  Description of Artificial Sequence: Synthetic oligonucleotide
  Target: ATXN1; (+) strand; PAM type: YTN; PAM sequence: CTG
cacaggtaccctcacctttc

SEQ ID NO: 311571 - DNA, 20 bp, Artificial Sequence
  Description of Artificial Sequence: Synthetic oligonucleotide
  Target: ATXN1; (+) strand; PAM type: YTN; PAM sequence: CTC
acctttcctgccggcgaacg

SEQ ID NO: 311572 - DNA, 20 bp, Artificial Sequence
  Description of Artificial Sequence: Synthetic oligonucleotide
  Target: ATXN1; (+) strand; PAM type: YTN; PAM sequence: CTT
tcctgccggcgaacgctggc

SEQ ID NO: 311573 - DNA, 20 bp, Artificial Sequence
  Description of Artificial Sequence: Synthetic oligonucleotide
  Target: ATXN1; (+) strand; PAM type: YTN; PAM sequence: TTT
cctgccggcgaacgctggcg

SEQ ID NO: 311574 - DNA, 20 bp, Artificial Sequence
  Description of Artificial Sequence: Synthetic oligonucleotide
  Target: ATXN1; (+) strand; PAM type: YTN; PAM sequence: TTC
ctgccggcgaacgctggcga

SEQ ID NO: 311575 - DNA, 20 bp, Artificial Sequence
  Description of Artificial Sequence: Synthetic oligonucleotide
  Target: ATXN1; (+) strand; PAM type: YTN; PAM sequence: CTG
ccggcgaacgctggcgaccg

SEQ ID NO: 311576 - DNA, 20 bp, Artificial Sequence
  Description of Artificial Sequence: Synthetic oligonucleotide
  Target: ATXN1; (+) strand; PAM type: YTN; PAM sequence: CTG
gcgaccgcccgaccctgccc

SEQ ID NO: 311577 - DNA, 20 bp, Artificial Sequence
  Description of Artificial Sequence: Synthetic oligonucleotide
  Target: ATXN1; (+) strand; PAM type: YTN; PAM sequence: CTG
ccctctttctctcttcgcac

SEQ ID NO: 311578 - DNA, 20 bp, Artificial Sequence
  Description of Artificial Sequence: Synthetic oligonucleotide
  Target: ATXN1; (+) strand; PAM type: YTN; PAM sequence: CTC
tttctctcttcgcacgcagg

SEQ ID NO: 311579 - DNA, 20 bp, Artificial Sequence
  Description of Artificial Sequence: Synthetic oligonucleotide
  Target: ATXN1; (+) strand; PAM type: YTN; PAM sequence: CTT
tctctcttcgcacgcaggtc

SEQ ID NO: 311580 - DNA, 20 bp, Artificial Sequence
  Description of Artificial Sequence: Synthetic oligonucleotide
  Target: ATXN1; (+) strand; PAM type: YTN; PAM sequence: TTT
ctctcttcgcacgcaggtcc

SEQ ID NO: 311581 - DNA, 20 bp, Artificial Sequence
  Description of Artificial Sequence: Synthetic oligonucleotide
  Target: ATXN1; (+) strand; PAM type: YTN; PAM sequence: TTC
tctcttcgcacgcaggtccg

SEQ ID NO: 311582 - DNA, 20 bp, Artificial Sequence
  Description of Artificial Sequence: Synthetic oligonucleotide
  Target: ATXN1; (+) strand; PAM type: YTN; PAM sequence: CTC
tcttcgcacgcaggtccgga

SEQ ID NO: 311583 - DNA, 20 bp, Artificial Sequence
  Description of Artificial Sequence: Synthetic oligonucleotide
  Target: ATXN1; (+) strand; PAM type: YTN; PAM sequence: CTC
ttcgcacgcaggtccggaaa

SEQ ID NO: 311584 - DNA, 20 bp, Artificial Sequence
  Description of Artificial Sequence: Synthetic oligonucleotide
  Target: ATXN1; (+) strand; PAM type: YTN; PAM sequence: CTT
cgcacgcaggtccggaaatc

SEQ ID NO: 311585 - DNA, 20 bp, Artificial Sequence
  Description of Artificial Sequence: Synthetic oligonucleotide
  Target: ATXN1; (+) strand; PAM type: YTN; PAM sequence: TTC
gcacgcaggtccggaaatcg

SEQ ID NO: 311586 - DNA, 20 bp, Artificial Sequence
  Description of Artificial Sequence: Synthetic oligonucleotide
  Target: ATXN1; (+) strand; PAM type: YTN; PAM sequence: CTT
tgatatggaactactccgct

SEQ ID NO: 311587 - DNA, 20 bp, Artificial Sequence
  Description of Artificial Sequence: Synthetic oligonucleotide
  Target: ATXN1; (+) strand; PAM type: YTN; PAM sequence: TTT
gatatggaactactccgctc

SEQ ID NO: 311588 - DNA, 20 bp, Artificial Sequence
  Description of Artificial Sequence: Synthetic oligonucleotide
  Target: ATXN1; (+) strand; PAM type: YTN; PAM sequence: TTG
atatggaactactccgctct

SEQ ID NO: 311589 - DNA, 20 bp, Artificial Sequence
  Description of Artificial Sequence: Synthetic oligonucleotide
  Target: ATXN1; (+) strand; PAM type: YTN; PAM sequence: CTA
ctccgctctagcctggaaag

SEQ ID NO: 311590 - DNA, 20 bp, Artificial Sequence
  Description of Artificial Sequence: Synthetic oligonucleotide
  Target: ATXN1; (+) strand; PAM type: YTN; PAM sequence: CTC
cgctctagcctggaaaggag

SEQ ID NO: 311591 - DNA, 20 bp, Artificial Sequence
  Description of Artificial Sequence: Synthetic oligonucleotide
  Target: ATXN1; (+) strand; PAM type: YTN; PAM sequence: CTC
tagcctggaaaggagacccg

SEQ ID NO: 311592 - DNA, 20 bp, Artificial Sequence
  Description of Artificial Sequence: Synthetic oligonucleotide
  Target: ATXN1; (+) strand; PAM type: YTN; PAM sequence: CTA
gcctggaaaggagacccgcg

SEQ ID NO: 311593 - DNA, 20 bp, Artificial Sequence
  Description of Artificial Sequence: Synthetic oligonucleotide
  Target: ATXN1; (+) strand; PAM type: YTN; PAM sequence: CTG
gaaaggagacccgcgcactc

SEQ ID NO: 311594 - DNA, 20 bp, Artificial Sequence
  Description of Artificial Sequence: Synthetic oligonucleotide
  Target: ATXN1; (+) strand; PAM type: YTN; PAM sequence: CTC
ctctcgcagctaatttcgga

SEQ ID NO: 311595 - DNA, 20 bp, Artificial Sequence
  Description of Artificial Sequence: Synthetic oligonucleotide
  Target: ATXN1; (+) strand; PAM type: YTN; PAM sequence: CTC
tcgcagctaatttcggatca

SEQ ID NO: 311596 - DNA, 20 bp, Artificial Sequence
  Description of Artificial Sequence: Synthetic oligonucleotide
  Target: ATXN1; (+) strand; PAM type: YTN; PAM sequence: CTC
gcagctaatttcggatcatt

SEQ ID NO: 311597 - DNA, 20 bp, Artificial Sequence
  Description of Artificial Sequence: Synthetic oligonucleotide
  Target: ATXN1; (+) strand; PAM type: YTN; PAM sequence: CTA
atttcggatcattaatttaa

SEQ ID NO: 311598 - DNA, 20 bp, Artificial Sequence
  Description of Artificial Sequence: Synthetic oligonucleotide
  Target: ATXN1; (+) strand; PAM type: YTN; PAM sequence: TTT
cggatcattaatttaatcgg

SEQ ID NO: 311599 - DNA, 20 bp, Artificial Sequence
  Description of Artificial Sequence: Synthetic oligonucleotide
  Target: ATXN1; (+) strand; PAM type: YTN; PAM sequence: TTC
ggatcattaatttaatcgga

SEQ ID NO: 311600 - DNA, 20 bp, Artificial Sequence
  Description of Artificial Sequence: Synthetic oligonucleotide
  Target: ATXN1; (+) strand; PAM type: YTN; PAM sequence: TTA
atttaatcggaaatgaggta

SEQ ID NO: 311601 - DNA, 20 bp, Artificial Sequence
  Description of Artificial Sequence: Synthetic oligonucleotide
  Target: ATXN1; (+) strand; PAM type: YTN; PAM sequence: TTT
aatcggaaatgaggtaacca

SEQ ID NO: 311602 - DNA, 20 bp, Artificial Sequence
  Description of Artificial Sequence: Synthetic oligonucleotide
  Target: ATXN1; (+) strand; PAM type: YTN; PAM sequence: TTA
atcggaaatgaggtaaccag

SEQ ID NO: 311603 - DNA, 20 bp, Artificial Sequence
  Description of Artificial Sequence: Synthetic oligonucleotide
  Target: ATXN1; (+) strand; PAM type: YTN; PAM sequence: TTC
tcgagaatcgacgaggaact

SEQ ID NO: 311604 - DNA, 20 bp, Artificial Sequence
  Description of Artificial Sequence: Synthetic oligonucleotide
  Target: ATXN1; (+) strand; PAM type: YTN; PAM sequence: CTC
gagaatcgacgaggaactta

SEQ ID NO: 311605 - DNA, 20 bp, Artificial Sequence
  Description of Artificial Sequence: Synthetic oligonucleotide
  Target: ATXN1; (+) strand; PAM type: YTN; PAM sequence: CTT
aaatctggactcagggtttc

SEQ ID NO: 311606 - DNA, 20 bp, Artificial Sequence
  Description of Artificial Sequence: Synthetic oligonucleotide
  Target: ATXN1; (+) strand; PAM type: YTN; PAM sequence: TTA
aatctggactcagggtttca

SEQ ID NO: 311607 - DNA, 20 bp, Artificial Sequence
  Description of Artificial Sequence: Synthetic oligonucleotide
  Target: ATXN1; (+) strand; PAM type: YTN; PAM sequence: CTG
gactcagggtttcagtgcgg

SEQ ID NO: 311608 - DNA, 20 bp, Artificial Sequence
  Description of Artificial Sequence: Synthetic oligonucleotide
  Target: ATXN1; (+) strand; PAM type: YTN; PAM sequence: CTC
agggtttcagtgcggtctcc

SEQ ID NO: 311609 - DNA, 20 bp, Artificial Sequence
  Description of Artificial Sequence: Synthetic oligonucleotide
  Target: ATXN1; (+) strand; PAM type: YTN; PAM sequence: TTT
cagtgcggtctccgactccc

SEQ ID NO: 311610 - DNA, 20 bp, Artificial Sequence
  Description of Artificial Sequence: Synthetic oligonucleotide
  Target: ATXN1; (+) strand; PAM type: YTN; PAM sequence: TTC
agtgcggtctccgactccca

SEQ ID NO: 311611 - DNA, 20 bp, Artificial Sequence
  Description of Artificial Sequence: Synthetic oligonucleotide
  Target: ATXN1; (+) strand; PAM type: YTN; PAM sequence: CTC
cgactcccaccaccccgccc

SEQ ID NO: 311612 - DNA, 20 bp, Artificial Sequence
  Description of Artificial Sequence: Synthetic oligonucleotide
  Target: ATXN1; (+) strand; PAM type: YTN; PAM sequence: CTC
ccaccaccccgcccctccgc

SEQ ID NO: 311613 - DNA, 20 bp, Artificial Sequence
  Description of Artificial Sequence: Synthetic oligonucleotide
  Target: ATXN1; (+) strand; PAM type: YTN; PAM sequence: CTC
cgcctgtctcgccgccaggt

SEQ ID NO: 311614 - DNA, 20 bp, Artificial Sequence
  Description of Artificial Sequence: Synthetic oligonucleotide
  Target: ATXN1; (+) strand; PAM type: YTN; PAM sequence: CTG
tctcgccgccaggtgtgacc

SEQ ID NO: 311615 - DNA, 20 bp, Artificial Sequence
  Description of Artificial Sequence: Synthetic oligonucleotide
  Target: ATXN1; (+) strand; PAM type: YTN; PAM sequence: CTC
gccgccaggtgtgacctcca

SEQ ID NO: 311616 - DNA, 20 bp, Artificial Sequence
  Description of Artificial Sequence: Synthetic oligonucleotide
  Target: ATXN1; (+) strand; PAM type: YTN; PAM sequence: CTC
cacgcgaaggaatcttcttc

SEQ ID NO: 311617 - DNA, 20 bp, Artificial Sequence
  Description of Artificial Sequence: Synthetic oligonucleotide
  Target: ATXN1; (+) strand; PAM type: YTN; PAM sequence: CTT
cttcggatgggtgcaccttg

SEQ ID NO: 311618 - DNA, 20 bp, Artificial Sequence
  Description of Artificial Sequence: Synthetic oligonucleotide
  Target: ATXN1; (+) strand; PAM type: YTN; PAM sequence: TTC
ttcggatgggtgcaccttgc

SEQ ID NO: 311619 - DNA, 20 bp, Artificial Sequence
  Description of Artificial Sequence: Synthetic oligonucleotide
  Target: ATXN1; (+) strand; PAM type: YTN; PAM sequence: CTT
cggatgggtgcaccttgcca

SEQ ID NO: 311620 - DNA, 20 bp, Artificial Sequence
  Description of Artificial Sequence: Synthetic oligonucleotide
  Target: ATXN1; (+) strand; PAM type: YTN; PAM sequence: TTC
ggatgggtgcaccttgccaa

SEQ ID NO: 311621 - DNA, 20 bp, Artificial Sequence
  Description of Artificial Sequence: Synthetic oligonucleotide
  Target: ATXN1; (+) strand; PAM type: YTN; PAM sequence: CTT
gccaacaggtgtggcacctg

SEQ ID NO: 311622 - DNA, 20 bp, Artificial Sequence
  Description of Artificial Sequence: Synthetic oligonucleotide
  Target: ATXN1; (+) strand; PAM type: YTN; PAM sequence: TTG
ccaacaggtgtggcacctgg

SEQ ID NO: 311623 - DNA, 20 bp, Artificial Sequence
  Description of Artificial Sequence: Synthetic oligonucleotide
  Target: ATXN1; (+) strand; PAM type: YTN; PAM sequence: CTG
gaggactaggaggcgcctcc

SEQ ID NO: 311624 - DNA, 20 bp, Artificial Sequence
  Description of Artificial Sequence: Synthetic oligonucleotide
  Target: ATXN1; (+) strand; PAM type: YTN; PAM sequence: CTA
ggaggcgcctccagactaag

SEQ ID NO: 311625 - DNA, 20 bp, Artificial Sequence
  Description of Artificial Sequence: Synthetic oligonucleotide
  Target: ATXN1; (+) strand; PAM type: YTN; PAM sequence: CTC
cagactaagggcgctcagtg

SEQ ID NO: 311626 - DNA, 20 bp, Artificial Sequence
  Description of Artificial Sequence: Synthetic oligonucleotide
  Target: ATXN1; (+) strand; PAM type: YTN; PAM sequence: CTA
agggcgctcagtgcggcgtt

SEQ ID NO: 311627 - DNA, 20 bp, Artificial Sequence
  Description of Artificial Sequence: Synthetic oligonucleotide
  Target: ATXN1; (+) strand; PAM type: YTN; PAM sequence: CTC
agtgcggcgttcttgttgca

SEQ ID NO: 311628 - DNA, 20 bp, Artificial Sequence
  Description of Artificial Sequence: Synthetic oligonucleotide
  Target: ATXN1; (+) strand; PAM type: YTN; PAM sequence: TTC
ttgttgcagatgattctgga

SEQ ID NO: 311629 - DNA, 20 bp, Artificial Sequence
  Description of Artificial Sequence: Synthetic oligonucleotide
  Target: ATXN1; (+) strand; PAM type: YTN; PAM sequence: CTT
gttgcagatgattctggaag

SEQ ID NO: 311630 - DNA, 20 bp, Artificial Sequence
  Description of Artificial Sequence: Synthetic oligonucleotide
  Target: ATXN1; (+) strand; PAM type: YTN; PAM sequence: TTG
ttgcagatgattctggaagg

SEQ ID NO: 311631 - DNA, 20 bp, Artificial Sequence
  Description of Artificial Sequence: Synthetic oligonucleotide
  Target: ATXN1; (+) strand; PAM type: YTN; PAM sequence: TTG
cagatgattctggaaggccg

SEQ ID NO: 311632 - DNA, 20 bp, Artificial Sequence
  Description of Artificial Sequence: Synthetic oligonucleotide
  Target: ATXN1; (+) strand; PAM type: YTN; PAM sequence: TTC
tggaaggccggtaggtgtcg

SEQ ID NO: 311633 - DNA, 20 bp, Artificial Sequence
  Description of Artificial Sequence: Synthetic oligonucleotide
  Target: ATXN1; (+) strand; PAM type: YTN; PAM sequence: CTG
gaaggccggtaggtgtcggg

SEQ ID NO: 311634 - DNA, 20 bp, Artificial Sequence
  Description of Artificial Sequence: Synthetic oligonucleotide
  Target: ATXN1; (+) strand; PAM type: YTN; PAM sequence: TTT
gaccttcttcaggtgcttag

SEQ ID NO: 311635 - DNA, 20 bp, Artificial Sequence
  Description of Artificial Sequence: Synthetic oligonucleotide
  Target: ATXN1; (+) strand; PAM type: YTN; PAM sequence: TTG
accttcttcaggtgcttaga

SEQ ID NO: 311636 - DNA, 20 bp, Artificial Sequence
  Description of Artificial Sequence: Synthetic oligonucleotide
  Target: ATXN1; (+) strand; PAM type: YTN; PAM sequence: CTT
cttcaggtgcttagaactaa

SEQ ID NO: 311637 - DNA, 20 bp, Artificial Sequence
  Description of Artificial Sequence: Synthetic oligonucleotide
  Target: ATXN1; (+) strand; PAM type: YTN; PAM sequence: TTC
ttcaggtgcttagaactaag

SEQ ID NO: 311638 - DNA, 20 bp, Artificial Sequence
  Description of Artificial Sequence: Synthetic oligonucleotide
  Target: ATXN1; (+) strand; PAM type: YTN; PAM sequence: CTT
caggtgcttagaactaagtg

SEQ ID NO: 311639 - DNA, 20 bp, Artificial Sequence
  Description of Artificial Sequence: Synthetic oligonucleotide
  Target: ATXN1; (+) strand; PAM type: YTN; PAM sequence: TTC
aggtgcttagaactaagtgt

SEQ ID NO: 311640 - DNA, 20 bp, Artificial Sequence
  Description of Artificial Sequence: Synthetic oligonucleotide
  Target: ATXN1; (+) strand; PAM type: YTN; PAM sequence: CTT
agaactaagtgtctggaaac

SEQ ID NO: 311641 - DNA, 20 bp, Artificial Sequence
  Description of Artificial Sequence: Synthetic oligonucleotide
  Target: ATXN1; (+) strand; PAM type: YTN; PAM sequence: TTA
gaactaagtgtctggaaaca

SEQ ID NO: 311642 - DNA, 20 bp, Artificial Sequence
  Description of Artificial Sequence: Synthetic oligonucleotide
  Target: ATXN1; (+) strand; PAM type: YTN; PAM sequence: CTA
agtgtctggaaacatgatcc

SEQ ID NO: 311643 - DNA, 20 bp, Artificial Sequence
  Description of Artificial Sequence: Synthetic oligonucleotide
  Target: ATXN1; (+) strand; PAM type: YTN; PAM sequence: CTG
gaaacatgatcctttcgcgt

SEQ ID NO: 311644 - DNA, 20 bp, Artificial Sequence
  Description of Artificial Sequence: Synthetic oligonucleotide
  Target: ATXN1; (+) strand; PAM type: YTN; PAM sequence: CTT
tcgcgtaagtttctttctga

SEQ ID NO: 311645 - DNA, 20 bp, Artificial Sequence
  Description of Artificial Sequence: Synthetic oligonucleotide
  Target: ATXN1; (+) strand; PAM type: YTN; PAM sequence: TTT
cgcgtaagtttctttctgaa

SEQ ID NO: 311646 - DNA, 20 bp, Artificial Sequence
  Description of Artificial Sequence: Synthetic oligonucleotide
  Target: ATXN1; (+) strand; PAM type: YTN; PAM sequence: TTC
gcgtaagtttctttctgaaa

SEQ ID NO: 311647 - DNA, 20 bp, Artificial Sequence
  Description of Artificial Sequence: Synthetic oligonucleotide
  Target: ATXN1; (+) strand; PAM type: YTN; PAM sequence: TTT
ctttctgaaagccaccaatc

SEQ ID NO: 311648 - DNA, 20 bp, Artificial Sequence
  Description of Artificial Sequence: Synthetic oligonucleotide
  Target: ATXN1; (+) strand; PAM type: YTN; PAM sequence: TTC
tttctgaaagccaccaatct

SEQ ID NO: 311649 - DNA, 20 bp, Artificial Sequence
  Description of Artificial Sequence: Synthetic oligonucleotide
  Target: ATXN1; (+) strand; PAM type: YTN; PAM sequence: CTT
tctgaaagccaccaatcttg

SEQ ID NO: 311650 - DNA, 20 bp, Artificial Sequence
  Description of Artificial Sequence: Synthetic oligonucleotide
  Target: ATXN1; (+) strand; PAM type: YTN; PAM sequence: TTT
ctgaaagccaccaatcttga

SEQ ID NO: 311651 - DNA, 20 bp, Artificial Sequence
  Description of Artificial Sequence: Synthetic oligonucleotide
  Target: ATXN1; (+) strand; PAM type: YTN; PAM sequence: TTC
tgaaagccaccaatcttgac

SEQ ID NO: 311652 - DNA, 20 bp, Artificial Sequence
  Description of Artificial Sequence: Synthetic oligonucleotide
  Target: ATXN1; (+) strand; PAM type: YTN; PAM sequence: CTG
aaagccaccaatcttgactg

SEQ ID NO: 311653 - DNA, 20 bp, Artificial Sequence
  Description of Artificial Sequence: Synthetic oligonucleotide
  Target: ATXN1; (+) strand; PAM type: YTN; PAM sequence: CTT
gactgtaagctgtatttgag

SEQ ID NO: 311654 - DNA, 20 bp, Artificial Sequence
  Description of Artificial Sequence: Synthetic oligonucleotide
  Target: ATXN1; (+) strand; PAM type: YTN; PAM sequence: TTG
actgtaagctgtatttgaga

SEQ ID NO: 311655 - DNA, 20 bp, Artificial Sequence
  Description of Artificial Sequence: Synthetic oligonucleotide
  Target: ATXN1; (+) strand; PAM type: YTN; PAM sequence: CTG
taagctgtatttgagagatc

SEQ ID NO: 311656 - DNA, 20 bp, Artificial Sequence
  Description of Artificial Sequence: Synthetic oligonucleotide
  Target: ATXN1; (+) strand; PAM type: YTN; PAM sequence: CTG
tatttgagagatcttttggc

SEQ ID NO: 311657 - DNA, 20 bp, Artificial Sequence
  Description of Artificial Sequence: Synthetic oligonucleotide
  Target: ATXN1; (+) strand; PAM type: YTN; PAM sequence: TTT
gagagatcttttggctgagt

SEQ ID NO: 311658 - DNA, 20 bp, Artificial Sequence
  Description of Artificial Sequence: Synthetic oligonucleotide
  Target: ATXN1; (+) strand; PAM type: YTN; PAM sequence: TTG
agagatcttttggctgagtt

SEQ ID NO: 311659 - DNA, 20 bp, Artificial Sequence
  Description of Artificial Sequence: Synthetic oligonucleotide
  Target: ATXN1; (+) strand; PAM type: YTN; PAM sequence: CTT
ttggctgagtttacttatga

SEQ ID NO: 311660 - DNA, 20 bp, Artificial Sequence
  Description of Artificial Sequence: Synthetic oligonucleotide
  Target: ATXN1; (+) strand; PAM type: YTN; PAM sequence: TTT
tggctgagtttacttatgac

SEQ ID NO: 311661 - DNA, 20 bp, Artificial Sequence
  Description of Artificial Sequence: Synthetic oligonucleotide
  Target: ATXN1; (+) strand; PAM type: YTN; PAM sequence: TTT
ggctgagtttacttatgacc

SEQ ID NO: 311662 - DNA, 20 bp, Artificial Sequence
  Description of Artificial Sequence: Synthetic oligonucleotide
  Target: ATXN1; (+) strand; PAM type: YTN; PAM sequence: TTG
gctgagtttacttatgacct

SEQ ID NO: 311663 - DNA, 20 bp, Artificial Sequence
  Description of Artificial Sequence: Synthetic oligonucleotide
  Target: ATXN1; (+) strand; PAM type: YTN; PAM sequence: CTG
agtttacttatgacctaacg

SEQ ID NO: 311664 - DNA, 20 bp, Artificial Sequence
  Description of Artificial Sequence: Synthetic oligonucleotide
  Target: ATXN1; (+) strand; PAM type: YTN; PAM sequence: TTT
acttatgacctaacggttag

SEQ ID NO: 311665 - DNA, 20 bp, Artificial Sequence
  Description of Artificial Sequence: Synthetic oligonucleotide
  Target: ATXN1; (+) strand; PAM type: YTN; PAM sequence: TTA
cttatgacctaacggttagt

SEQ ID NO: 311666 - DNA, 20 bp, Artificial Sequence
  Description of Artificial Sequence: Synthetic oligonucleotide
  Target: ATXN1; (+) strand; PAM type: YTN; PAM sequence: CTT
atgacctaacggttagtcac

SEQ ID NO: 311667 - DNA, 20 bp, Artificial Sequence
  Description of Artificial Sequence: Synthetic oligonucleotide
  Target: ATXN1; (+) strand; PAM type: YTN; PAM sequence: TTA
tgacctaacggttagtcacc

SEQ ID NO: 311668 - DNA, 20 bp, Artificial Sequence
  Description of Artificial Sequence: Synthetic oligonucleotide
  Target: ATXN1; (+) strand; PAM type: YTN; PAM sequence: CTA
acggttagtcaccaactgag

SEQ ID NO: 311669 - DNA, 20 bp, Artificial Sequence
  Description of Artificial Sequence: Synthetic oligonucleotide
  Target: ATXN1; (+) strand; PAM type: YTN; PAM sequence: TTA
gtcaccaactgaggcagggc

SEQ ID NO: 311670 - DNA, 20 bp, Artificial Sequence
  Description of Artificial Sequence: Synthetic oligonucleotide
  Target: ATXN1; (+) strand; PAM type: YTN; PAM sequence: CTG
aggcagggcacaggatgacc

SEQ ID NO: 311671 - DNA, 20 bp, Artificial Sequence
  Description of Artificial Sequence: Synthetic oligonucleotide
  Target: ATXN1; (+) strand; PAM type: YTN; PAM sequence: TTT
ttacacaactctggcctgca

SEQ ID NO: 311672 - DNA, 20 bp, Artificial Sequence
  Description of Artificial Sequence: Synthetic oligonucleotide
  Target: ATXN1; (+) strand; PAM type: YTN; PAM sequence: TTT
tacacaactctggcctgcaa

SEQ ID NO: 311673 - DNA, 20 bp, Artificial Sequence
  Description of Artificial Sequence: Synthetic oligonucleotide
  Target: ATXN1; (+) strand; PAM type: YTN; PAM sequence: TTT
acacaactctggcctgcaag

SEQ ID NO: 311674 - DNA, 20 bp, Artificial Sequence
  Description of Artificial Sequence: Synthetic oligonucleotide
  Target: ATXN1; (+) strand; PAM type: YTN; PAM sequence: TTA
cacaactctggcctgcaaga

SEQ ID NO: 311675 - DNA, 20 bp, Artificial Sequence
  Description of Artificial Sequence: Synthetic oligonucleotide
  Target: ATXN1; (+) strand; PAM type: YTN; PAM sequence: CTC
tggcctgcaagagcctacgt

SEQ ID NO: 311676 - DNA, 20 bp, Artificial Sequence
  Description of Artificial Sequence: Synthetic oligonucleotide
  Target: ATXN1; (+) strand; PAM type: YTN; PAM sequence: CTG
gcctgcaagagcctacgtgc

SEQ ID NO: 311677 - DNA, 20 bp, Artificial Sequence
  Description of Artificial Sequence: Synthetic oligonucleotide
  Target: ATXN1; (+) strand; PAM type: YTN; PAM sequence: CTG
caagagcctacgtgcttcat

SEQ ID NO: 311678 - DNA, 20 bp, Artificial Sequence
  Description of Artificial Sequence: Synthetic oligonucleotide
  Target: ATXN1; (+) strand; PAM type: YTN; PAM sequence: CTA
cgtgcttcataaataaaaat

SEQ ID NO: 311679 - DNA, 20 bp, Artificial Sequence
  Description of Artificial Sequence: Synthetic oligonucleotide
  Target: ATXN1; (+) strand; PAM type: YTN; PAM sequence: CTT
cataaataaaaataaacata

SEQ ID NO: 311680 - DNA, 20 bp, Artificial Sequence
  Description of Artificial Sequence: Synthetic oligonucleotide
  Target: ATXN1; (+) strand; PAM type: YTN; PAM sequence: TTC
ataaataaaaataaacatac

SEQ ID NO: 311681 - DNA, 20 bp, Artificial Sequence
  Description of Artificial Sequence: Synthetic oligonucleotide
  Target: ATXN1; (+) strand; PAM type: YTN; PAM sequence: TTT
ttttctcacatttttgaaat

SEQ ID NO: 311682 - DNA, 20 bp, Artificial Sequence
  Description of Artificial Sequence: Synthetic oligonucleotide
  Target: ATXN1; (+) strand; PAM type: YTN; PAM sequence: TTT
tttctcacatttttgaaata

SEQ ID NO: 311683 - DNA, 20 bp, Artificial Sequence
  Description of Artificial Sequence: Synthetic oligonucleotide
  Target: ATXN1; (+) strand; PAM type: YTN; PAM sequence: TTT
ttctcacatttttgaaatac

SEQ ID NO: 311684 - DNA, 20 bp, Artificial Sequence
  Description of Artificial Sequence: Synthetic oligonucleotide
  Target: ATXN1; (+) strand; PAM type: YTN; PAM sequence: TTT
tctcacatttttgaaatacc

SEQ ID NO: 311685 - DNA, 20 bp, Artificial Sequence
  Description of Artificial Sequence: Synthetic oligonucleotide
  Target: ATXN1; (+) strand; PAM type: YTN; PAM sequence: TTT
ctcacatttttgaaatacca

SEQ ID NO: 311686 - DNA, 20 bp, Artificial Sequence
  Description of Artificial Sequence: Synthetic oligonucleotide
  Target: ATXN1; (+) strand; PAM type: YTN; PAM sequence: TTC
tcacatttttgaaataccat

SEQ ID NO: 311687 - DNA, 20 bp, Artificial Sequence
  Description of Artificial Sequence: Synthetic oligonucleotide
  Target: ATXN1; (+) strand; PAM type: YTN; PAM sequence: CTC
acatttttgaaataccatgc

SEQ ID NO: 311688 - DNA, 20 bp, Artificial Sequence
  Description of Artificial Sequence: Synthetic oligonucleotide
  Target: ATXN1; (+) strand; PAM type: YTN; PAM sequence: TTT
ttgaaataccatgcacatat

SEQ ID NO: 311689 - DNA, 20 bp, Artificial Sequence
  Description of Artificial Sequence: Synthetic oligonucleotide
  Target: ATXN1; (+) strand; PAM type: YTN; PAM sequence: TTT
tgaaataccatgcacatata

SEQ ID NO: 311690 - DNA, 20 bp, Artificial Sequence
  Description of Artificial Sequence: Synthetic oligonucleotide
  Target: ATXN1; (+) strand; PAM type: YTN; PAM sequence: TTT
gaaataccatgcacatatat

SEQ ID NO: 311691 - DNA, 20 bp, Artificial Sequence
  Description of Artificial Sequence: Synthetic oligonucleotide
  Target: ATXN1; (+) strand; PAM type: YTN; PAM sequence: TTG
aaataccatgcacatatatg

SEQ ID NO: 311692 - DNA, 20 bp, Artificial Sequence
  Description of Artificial Sequence: Synthetic oligonucleotide
  Target: ATXN1; (+) strand; PAM type: YTN; PAM sequence: CTA
tttaagtataactactagtg

SEQ ID NO: 311693 - DNA, 20 bp, Artificial Sequence
  Description of Artificial Sequence: Synthetic oligonucleotide
  Target: ATXN1; (+) strand; PAM type: YTN; PAM sequence: TTT
aagtataactactagtgttc

SEQ ID NO: 311694 - DNA, 20 bp, Artificial Sequence
  Description of Artificial Sequence: Synthetic oligonucleotide
  Target: ATXN1; (+) strand; PAM type: YTN; PAM sequence: TTA
agtataactactagtgttca

SEQ ID NO: 311695 - DNA, 20 bp, Artificial Sequence
  Description of Artificial Sequence: Synthetic oligonucleotide
  Target: ATXN1; (+) strand; PAM type: YTN; PAM sequence: CTA
ctagtgttcactcttactca

SEQ ID NO: 311696 - DNA, 20 bp, Artificial Sequence
  Description of Artificial Sequence: Synthetic oligonucleotide
  Target: ATXN1; (+) strand; PAM type: YTN; PAM sequence: CTA
gtgttcactcttactcattt

SEQ ID NO: 311697 - DNA, 20 bp, Artificial Sequence
  Description of Artificial Sequence: Synthetic oligonucleotide
  Target: ATXN1; (+) strand; PAM type: YTN; PAM sequence: TTC
actcttactcatttctacaa

SEQ ID NO: 311698 - DNA, 20 bp, Artificial Sequence
  Description of Artificial Sequence: Synthetic oligonucleotide
  Target: ATXN1; (+) strand; PAM type: YTN; PAM sequence: CTC
ttactcatttctacaacttt

SEQ ID NO: 311699 - DNA, 20 bp, Artificial Sequence
  Description of Artificial Sequence: Synthetic oligonucleotide
  Target: ATXN1; (+) strand; PAM type: YTN; PAM sequence: CTT
actcatttctacaacttttt

SEQ ID NO: 311700 - DNA, 20 bp, Artificial Sequence
  Description of Artificial Sequence: Synthetic oligonucleotide
  Target: ATXN1; (+) strand; PAM type: YTN; PAM sequence: TTA
ctcatttctacaactttttt

SEQ ID NO: 311701 - DNA, 20 bp, Artificial Sequence
  Description of Artificial Sequence: Synthetic oligonucleotide
  Target: ATXN1; (+) strand; PAM type: YTN; PAM sequence: CTC
atttctacaacttttttttt

SEQ ID NO: 311702 - DNA, 20 bp, Artificial Sequence
  Description of Artificial Sequence: Synthetic oligonucleotide
  Target: ATXN1; (+) strand; PAM type: YTN; PAM sequence: TTT
ctacaacttttttttttcca

SEQ ID NO: 311703 - DNA, 20 bp, Artificial Sequence
  Description of Artificial Sequence: Synthetic oligonucleotide
  Target: ATXN1; (+) strand; PAM type: YTN; PAM sequence: TTC
tacaacttttttttttccat

SEQ ID NO: 311704 - DNA, 20 bp, Artificial Sequence
  Description of Artificial Sequence: Synthetic oligonucleotide
  Target: ATXN1; (+) strand; PAM type: YTN; PAM sequence: CTA
caacttttttttttccattt

SEQ ID NO: 311705 - DNA, 20 bp, Artificial Sequence
  Description of Artificial Sequence: Synthetic oligonucleotide
  Target: ATXN1; (+) strand; PAM type: YTN; PAM sequence: CTT
ttttttttccatttaaaaat

SEQ ID NO: 311706 - DNA, 20 bp, Artificial Sequence
  Description of Artificial Sequence: Synthetic oligonucleotide
  Target: ATXN1; (+) strand; PAM type: YTN; PAM sequence: TTT
tttttttccatttaaaaatc

SEQ ID NO: 311707 - DNA, 20 bp, Artificial Sequence
  Description of Artificial Sequence: Synthetic oligonucleotide
  Target: ATXN1; (+) strand; PAM type: YTN; PAM sequence: TTT
ttttttccatttaaaaatcg

SEQ ID NO: 311708 - DNA, 20 bp, Artificial Sequence
  Description of Artificial Sequence: Synthetic oligonucleotide
  Target: ATXN1; (+) strand; PAM type: YTN; PAM sequence: TTT
tttttccatttaaaaatcga

SEQ ID NO: 311709 - DNA, 20 bp, Artificial Sequence
  Description of Artificial Sequence: Synthetic oligonucleotide
  Target: ATXN1; (+) strand; PAM type: YTN; PAM sequence: TTT
ttttccatttaaaaatcgat

SEQ ID NO: 311710 - DNA, 20 bp, Artificial Sequence
  Description of Artificial Sequence: Synthetic oligonucleotide
  Target: ATXN1; (+) strand; PAM type: YTN; PAM sequence: TTT
tttccatttaaaaatcgatt

SEQ ID NO: 311711 - DNA, 20 bp, Artificial Sequence
  Description of Artificial Sequence: Synthetic oligonucleotide
  Target: ATXN1; (+) strand; PAM type: YTN; PAM sequence: TTT
ttccatttaaaaatcgatta

SEQ ID NO: 311712 - DNA, 20 bp, Artificial Sequence
  Description of Artificial Sequence: Synthetic oligonucleotide
  Target: ATXN1; (+) strand; PAM type: YTN; PAM sequence: TTT
tccatttaaaaatcgattat

SEQ ID NO: 311713 - DNA, 20 bp, Artificial Sequence
  Description of Artificial Sequence: Synthetic oligonucleotide
  Target: ATXN1; (+) strand; PAM type: YTN; PAM sequence: TTT
ccatttaaaaatcgattatt

SEQ ID NO: 311714 - DNA, 20 bp, Artificial Sequence
  Description of Artificial Sequence: Synthetic oligonucleotide
  Target: ATXN1; (+) strand; PAM type: YTN; PAM sequence: TTC
catttaaaaatcgattattg

SEQ ID NO: 311715 - DNA, 20 bp, Artificial Sequence
  Description of Artificial Sequence: Synthetic oligonucleotide
  Target: ATXN1; (+) strand; PAM type: YTN; PAM sequence: TTT
aaaaatcgattattgttacg

SEQ ID NO: 311716 - DNA, 20 bp, Artificial Sequence
  Description of Artificial Sequence: Synthetic oligonucleotide
  Target: ATXN1; (+) strand; PAM type: YTN; PAM sequence: TTA
aaaatcgattattgttacgg

SEQ ID NO: 311717 - DNA, 20 bp, Artificial Sequence
  Description of Artificial Sequence: Synthetic oligonucleotide
  Target: ATXN1; (+) strand; PAM type: YTN; PAM sequence: TTA
ttgttacggtttaaacctcg

SEQ ID NO: 311718 - DNA, 20 bp, Artificial Sequence
  Description of Artificial Sequence: Synthetic oligonucleotide
  Target: ATXN1; (+) strand; PAM type: YTN; PAM sequence: TTG
ttacggtttaaacctcgggt

SEQ ID NO: 311719 - DNA, 20 bp, Artificial Sequence
  Description of Artificial Sequence: Synthetic oligonucleotide
  Target: ATXN1; (+) strand; PAM type: YTN; PAM sequence: TTA
cggtttaaacctcgggttgg

SEQ ID NO: 311720 - DNA, 20 bp, Artificial Sequence
  Description of Artificial Sequence: Synthetic oligonucleotide
  Target: ATXN1; (+) strand; PAM type: YTN; PAM sequence: TTT
aaacctcgggttggtctaaa

SEQ ID NO: 311721 - DNA, 20 bp, Artificial Sequence
  Description of Artificial Sequence: Synthetic oligonucleotide
  Target: ATXN1; (+) strand; PAM type: YTN; PAM sequence: TTA
aacctcgggttggtctaaag

SEQ ID NO: 311722 - DNA, 20 bp, Artificial Sequence
  Description of Artificial Sequence: Synthetic oligonucleotide
  Target: ATXN1; (+) strand; PAM type: YTN; PAM sequence: CTC
gggttggtctaaagtgacat

SEQ ID NO: 311723 - DNA, 20 bp, Artificial Sequence
  Description of Artificial Sequence: Synthetic oligonucleotide
  Target: ATXN1; (+) strand; PAM type: YTN; PAM sequence: TTG
gtctaaagtgacattgttgg

SEQ ID NO: 311724 - DNA, 20 bp, Artificial Sequence
  Description of Artificial Sequence: Synthetic oligonucleotide
  Target: ATXN1; (+) strand; PAM type: YTN; PAM sequence: CTA
aagtgacattgttggtctca

SEQ ID NO: 311725 - DNA, 20 bp, Artificial Sequence
  Description of Artificial Sequence: Synthetic oligonucleotide
  Target: ATXN1; (+) strand; PAM type: YTN; PAM sequence: TTG
ttggtctcattacagcctct

SEQ ID NO: 311726 - DNA, 20 bp, Artificial Sequence
  Description of Artificial Sequence: Synthetic oligonucleotide
  Target: ATXN1; (+) strand; PAM type: YTN; PAM sequence: TTG
gtctcattacagcctctagt

SEQ ID NO: 311727 - DNA, 20 bp, Artificial Sequence
  Description of Artificial Sequence: Synthetic oligonucleotide
  Target: ATXN1; (+) strand; PAM type: YTN; PAM sequence: CTC
attacagcctctagtggaca

SEQ ID NO: 311728 - DNA, 20 bp, Artificial Sequence
  Description of Artificial Sequence: Synthetic oligonucleotide
  Target: ATXN1; (+) strand; PAM type: YTN; PAM sequence: TTA
cagcctctagtggacagtta

SEQ ID NO: 311729 - DNA, 20 bp, Artificial Sequence
  Description of Artificial Sequence: Synthetic oligonucleotide
  Target: ATXN1; (+) strand; PAM type: YTN; PAM sequence: CTC
tagtggacagttaacatcag

SEQ ID NO: 311730 - DNA, 20 bp, Artificial Sequence
  Description of Artificial Sequence: Synthetic oligonucleotide
  Target: ATXN1; (+) strand; PAM type: YTN; PAM sequence: CTA
gtggacagttaacatcagtt

SEQ ID NO: 311731 - DNA, 20 bp, Artificial Sequence
  Description of Artificial Sequence: Synthetic oligonucleotide
  Target: ATXN1; (+) strand; PAM type: YTN; PAM sequence: TTA
acatcagtttcctgaaaagg

SEQ ID NO: 311732 - DNA, 20 bp, Artificial Sequence
  Description of Artificial Sequence: Synthetic oligonucleotide
  Target: ATXN1; (+) strand; PAM type: YTN; PAM sequence: TTT
cctgaaaaggctctgactgg

SEQ ID NO: 311733 - DNA, 20 bp, Artificial Sequence
  Description of Artificial Sequence: Synthetic oligonucleotide
  Target: ATXN1; (+) strand; PAM type: YTN; PAM sequence: TTC
ctgaaaaggctctgactggt

SEQ ID NO: 311734 - DNA, 20 bp, Artificial Sequence
  Description of Artificial Sequence: Synthetic oligonucleotide
  Target: ATXN1; (+) strand; PAM type: YTN; PAM sequence: CTG
aaaaggctctgactggtttt

SEQ ID NO: 311735 - DNA, 20 bp, Artificial Sequence
  Description of Artificial Sequence: Synthetic oligonucleotide
  Target: ATXN1; (+) strand; PAM type: YTN; PAM sequence: CTC
tgactggttttgttttcgtt

SEQ ID NO: 311736 - DNA, 20 bp, Artificial Sequence
  Description of Artificial Sequence: Synthetic oligonucleotide
  Target: ATXN1; (+) strand; PAM type: YTN; PAM sequence: CTG
actggttttgttttcgttga

SEQ ID NO: 311737 - DNA, 20 bp, Artificial Sequence
  Description of Artificial Sequence: Synthetic oligonucleotide
  Target: ATXN1; (+) strand; PAM type: YTN; PAM sequence: CTG
gttttgttttcgttgacaag

SEQ ID NO: 311738 - DNA, 20 bp, Artificial Sequence
  Description of Artificial Sequence: Synthetic oligonucleotide
  Target: ATXN1; (+) strand; PAM type: YTN; PAM sequence: TTT
tgttttcgttgacaagcttt

SEQ ID NO: 311739 - DNA, 20 bp, Artificial Sequence
  Description of Artificial Sequence: Synthetic oligonucleotide
  Target: ATXN1; (+) strand; PAM type: YTN; PAM sequence: TTT
gttttcgttgacaagctttg

SEQ ID NO: 311740 - DNA, 20 bp, Artificial Sequence
  Description of Artificial Sequence: Synthetic oligonucleotide
  Target: ATXN1; (+) strand; PAM type: YTN; PAM sequence: TTG
ttttcgttgacaagctttgt

SEQ ID NO: 311741 - DNA, 20 bp, Artificial Sequence
  Description of Artificial Sequence: Synthetic oligonucleotide
  Target: ATXN1; (+) strand; PAM type: YTN; PAM sequence: TTT
tcgttgacaagctttgtcaa

SEQ ID NO: 311742 - DNA, 20 bp, Artificial Sequence
  Description of Artificial Sequence: Synthetic oligonucleotide
  Target: ATXN1; (+) strand; PAM type: YTN; PAM sequence: TTT
cgttgacaagctttgtcaag

SEQ ID NO: 311743 - DNA, 20 bp, Artificial Sequence
  Description of Artificial Sequence: Synthetic oligonucleotide
  Target: ATXN1; (+) strand; PAM type: YTN; PAM sequence: TTC
gttgacaagctttgtcaagg

SEQ ID NO: 311744 - DNA, 20 bp, Artificial Sequence
  Description of Artificial Sequence: Synthetic oligonucleotide
  Target: ATXN1; (+) strand; PAM type: YTN; PAM sequence: TTG
acaagctttgtcaaggtgaa

SEQ ID NO: 311745 - DNA, 20 bp, Artificial Sequence
  Description of Artificial Sequence: Synthetic oligonucleotide
  Target: ATXN1; (+) strand; PAM type: YTN; PAM sequence: CTT
tgtcaaggtgaaggttagta

SEQ ID NO: 311746 - DNA, 20 bp, Artificial Sequence
  Description of Artificial Sequence: Synthetic oligonucleotide
  Target: ATXN1; (+) strand; PAM type: YTN; PAM sequence: TTT
gtcaaggtgaaggttagtac

SEQ ID NO: 311747 - DNA, 20 bp, Artificial Sequence
  Description of Artificial Sequence: Synthetic oligonucleotide
  Target: ATXN1; (+) strand; PAM type: YTN; PAM sequence: TTG
tcaaggtgaaggttagtacg

SEQ ID NO: 311748 - DNA, 20 bp, Artificial Sequence
  Description of Artificial Sequence: Synthetic oligonucleotide
  Target: ATXN1; (+) strand; PAM type: YTN; PAM sequence: TTA
gtacgtaagagcataaccgg

SEQ ID NO: 311749 - DNA, 20 bp, Artificial Sequence
  Description of Artificial Sequence: Synthetic oligonucleotide
  Target: ATXN1; (+) strand; PAM type: YTN; PAM sequence: CTC
acccctatcctcacccccgc

SEQ ID NO: 311750 - DNA, 20 bp, Artificial Sequence
  Description of Artificial Sequence: Synthetic oligonucleotide
  Target: ATXN1; (+) strand; PAM type: YTN; PAM sequence: CTA
tcctcacccccgcccccaac

SEQ ID NO: 311751 - DNA, 20 bp, Artificial Sequence
  Description of Artificial Sequence: Synthetic oligonucleotide
  Target: ATXN1; (+) strand; PAM type: YTN; PAM sequence: CTC
acccccgcccccaacaccct

SEQ ID NO: 311752 - DNA, 20 bp, Artificial Sequence
  Description of Artificial Sequence: Synthetic oligonucleotide
  Target: ATXN1; (+) strand; PAM type: YTN; PAM sequence: CTG
cttggcaaagacgacttcag

SEQ ID NO: 311753 - DNA, 20 bp, Artificial Sequence
  Description of Artificial Sequence: Synthetic oligonucleotide
  Target: ATXN1; (+) strand; PAM type: YTN; PAM sequence: CTT
ggcaaagacgacttcagaaa

SEQ ID NO: 311754 - DNA, 20 bp, Artificial Sequence
  Description of Artificial Sequence: Synthetic oligonucleotide
  Target: ATXN1; (+) strand; PAM type: YTN; PAM sequence: TTG
gcaaagacgacttcagaaag

SEQ ID NO: 311755 - DNA, 20 bp, Artificial Sequence
  Description of Artificial Sequence: Synthetic oligonucleotide
  Target: ATXN1; (+) strand; PAM type: YTN; PAM sequence: CTT
cagaaaggagcagaagcttg

SEQ ID NO: 311756 - DNA, 20 bp, Artificial Sequence
  Description of Artificial Sequence: Synthetic oligonucleotide
  Target: ATXN1; (+) strand; PAM type: YTN; PAM sequence: TTC
agaaaggagcagaagcttgt

SEQ ID NO: 311757 - DNA, 20 bp, Artificial Sequence
  Description of Artificial Sequence: Synthetic oligonucleotide
  Target: ATXN1; (+) strand; PAM type: YTN; PAM sequence: CTT
gttggctttatatagaaaag

SEQ ID NO: 311758 - DNA, 20 bp, Artificial Sequence
  Description of Artificial Sequence: Synthetic oligonucleotide
  Target: ATXN1; (+) strand; PAM type: YTN; PAM sequence: TTG
ttggctttatatagaaaaga

SEQ ID NO: 311759 - DNA, 20 bp, Artificial Sequence
  Description of Artificial Sequence: Synthetic oligonucleotide
  Target: ATXN1; (+) strand; PAM type: YTN; PAM sequence: TTG
gctttatatagaaaagacgt

SEQ ID NO: 311760 - DNA, 20 bp, Artificial Sequence
  Description of Artificial Sequence: Synthetic oligonucleotide
  Target: ATXN1; (+) strand; PAM type: YTN; PAM sequence: CTT
tatatagaaaagacgtatgc

SEQ ID NO: 311761 - DNA, 20 bp, Artificial Sequence
  Description of Artificial Sequence: Synthetic oligonucleotide
  Target: ATXN1; (+) strand; PAM type: YTN; PAM sequence: TTT
atatagaaaagacgtatgct

SEQ ID NO: 311762 - DNA, 20 bp, Artificial Sequence
  Description of Artificial Sequence: Synthetic oligonucleotide
  Target: ATXN1; (+) strand; PAM type: YTN; PAM sequence: TTA
tatagaaaagacgtatgctt

SEQ ID NO: 311763 - DNA, 20 bp, Artificial Sequence
  Description of Artificial Sequence: Synthetic oligonucleotide
  Target: ATXN1; (+) strand; PAM type: YTN; PAM sequence: CTT
tgtgctgcaggtattattat

SEQ ID NO: 311764 - DNA, 20 bp, Artificial Sequence
  Description of Artificial Sequence: Synthetic oligonucleotide
  Target: ATXN1; (+) strand; PAM type: YTN; PAM sequence: TTT
gtgctgcaggtattattatt

SEQ ID NO: 311765 - DNA, 20 bp, Artificial Sequence
  Description of Artificial Sequence: Synthetic oligonucleotide
  Target: ATXN1; (+) strand; PAM type: YTN; PAM sequence: TTG
tgctgcaggtattattatta

SEQ ID NO: 311766 - DNA, 20 bp, Artificial Sequence
  Description of Artificial Sequence: Synthetic oligonucleotide
  Target: ATXN1; (+) strand; PAM type: YTN; PAM sequence: CTG
caggtattattattactgga

SEQ ID NO: 311767 - DNA, 20 bp, Artificial Sequence
  Description of Artificial Sequence: Synthetic oligonucleotide
  Target: ATXN1; (+) strand; PAM type: YTN; PAM sequence: TTA
ttattactggactgtgaata

SEQ ID NO: 311768 - DNA, 20 bp, Artificial Sequence
  Description of Artificial Sequence: Synthetic oligonucleotide
  Target: ATXN1; (+) strand; PAM type: YTN; PAM sequence: TTA
ttactggactgtgaataaac

SEQ ID NO: 311769 - DNA, 20 bp, Artificial Sequence
  Description of Artificial Sequence: Synthetic oligonucleotide
  Target: ATXN1; (+) strand; PAM type: YTN; PAM sequence: TTA
ctggactgtgaataaacaga

SEQ ID NO: 311770 - DNA, 20 bp, Artificial Sequence
  Description of Artificial Sequence: Synthetic oligonucleotide
  Target: ATXN1; (+) strand; PAM type: YTN; PAM sequence: CTG
gactgtgaataaacagaaag

SEQ ID NO: 311771 - DNA, 20 bp, Artificial Sequence
  Description of Artificial Sequence: Synthetic oligonucleotide
  Target: ATXN1; (+) strand; PAM type: YTN; PAM sequence: CTG
tgaataaacagaaagcttct

SEQ ID NO: 311772 - DNA, 20 bp, Artificial Sequence
  Description of Artificial Sequence: Synthetic oligonucleotide
  Target: ATXN1; (+) strand; PAM type: YTN; PAM sequence: CTT
ctgctattcatttcagtttc

SEQ ID NO: 311773 - DNA, 20 bp, Artificial Sequence
  Description of Artificial Sequence: Synthetic oligonucleotide
  Target: ATXN1; (+) strand; PAM type: YTN; PAM sequence: TTC
tgctattcatttcagtttca

SEQ ID NO: 311774 - DNA, 20 bp, Artificial Sequence
  Description of Artificial Sequence: Synthetic oligonucleotide
  Target: ATXN1; (+) strand; PAM type: YTN; PAM sequence: CTG
ctattcatttcagtttcaga

SEQ ID NO: 311775 - DNA, 20 bp, Artificial Sequence
  Description of Artificial Sequence: Synthetic oligonucleotide
  Target: ATXN1; (+) strand; PAM type: YTN; PAM sequence: CTA
ttcatttcagtttcagacag

SEQ ID NO: 311776 - DNA, 20 bp, Artificial Sequence
  Description of Artificial Sequence: Synthetic oligonucleotide
  Target: ATXN1; (+) strand; PAM type: YTN; PAM sequence: TTC
atttcagtttcagacagctt

SEQ ID NO: 311777 - DNA, 20 bp, Artificial Sequence
  Description of Artificial Sequence: Synthetic oligonucleotide
  Target: ATXN1; (+) strand; PAM type: YTN; PAM sequence: TTT
cagtttcagacagctttcat

SEQ ID NO: 311778 - DNA, 20 bp, Artificial Sequence
  Description of Artificial Sequence: Synthetic oligonucleotide
  Target: ATXN1; (+) strand; PAM type: YTN; PAM sequence: TTC
agtttcagacagctttcata

SEQ ID NO: 311779 - DNA, 20 bp, Artificial Sequence
  Description of Artificial Sequence: Synthetic oligonucleotide
  Target: ATXN1; (+) strand; PAM type: YTN; PAM sequence: TTT
cagacagctttcataaaaac

SEQ ID NO: 311780 - DNA, 20 bp, Artificial Sequence
  Description of Artificial Sequence: Synthetic oligonucleotide
  Target: ATXN1; (+) strand; PAM type: YTN; PAM sequence: TTC
agacagctttcataaaaact

SEQ ID NO: 311781 - DNA, 20 bp, Artificial Sequence
  Description of Artificial Sequence: Synthetic oligonucleotide
  Target: ATXN1; (+) strand; PAM type: YTN; PAM sequence: CTT
tcataaaaactaaattcatc

SEQ ID NO: 311782 - DNA, 20 bp, Artificial Sequence
  Description of Artificial Sequence: Synthetic oligonucleotide
  Target: ATXN1; (+) strand; PAM type: YTN; PAM sequence: TTT
cataaaaactaaattcatct

SEQ ID NO: 311783 - DNA, 20 bp, Artificial Sequence
  Description of Artificial Sequence: Synthetic oligonucleotide
  Target: ATXN1; (+) strand; PAM type: YTN; PAM sequence: TTC
ataaaaactaaattcatctc

SEQ ID NO: 311784 - DNA, 20 bp, Artificial Sequence
  Description of Artificial Sequence: Synthetic oligonucleotide
  Target: ATXN1; (+) strand; PAM type: YTN; PAM sequence: CTA
aattcatctcaaatattttt

SEQ ID NO: 311785 - DNA, 20 bp, Artificial Sequence
  Description of Artificial Sequence: Synthetic oligonucleotide
  Target: ATXN1; (+) strand; PAM type: YTN; PAM sequence: TTC
atctcaaatatttttataac

SEQ ID NO: 311786 - DNA, 20 bp, Artificial Sequence
  Description of Artificial Sequence: Synthetic oligonucleotide
  Target: ATXN1; (+) strand; PAM type: YTN; PAM sequence: CTC
aaatatttttataacagaaa

SEQ ID NO: 311787 - DNA, 20 bp, Artificial Sequence
  Description of Artificial Sequence: Synthetic oligonucleotide
  Target: ATXN1; (+) strand; PAM type: YTN; PAM sequence: TTT
ttataacagaaaatattggt

SEQ ID NO: 311788 - DNA, 20 bp, Artificial Sequence
  Description of Artificial Sequence: Synthetic oligonucleotide
  Target: ATXN1; (+) strand; PAM type: YTN; PAM sequence: TTT
tataacagaaaatattggtt

SEQ ID NO: 311789 - DNA, 20 bp, Artificial Sequence
  Description of Artificial Sequence: Synthetic oligonucleotide
  Target: ATXN1; (+) strand; PAM type: YTN; PAM sequence: TTT
ataacagaaaatattggttg

SEQ ID NO: 311790 - DNA, 20 bp, Artificial Sequence
  Description of Artificial Sequence: Synthetic oligonucleotide
  Target: ATXN1; (+) strand; PAM type: YTN; PAM sequence: TTA
taacagaaaatattggttgc

SEQ ID NO: 311791 - DNA, 20 bp, Artificial Sequence
  Description of Artificial Sequence: Synthetic oligonucleotide
  Target: ATXN1; (+) strand; PAM type: YTN; PAM sequence: TTG
gttgccatgtttttggctta

SEQ ID NO: 311792 - DNA, 20 bp, Artificial Sequence
  Description of Artificial Sequence: Synthetic oligonucleotide
  Target: ATXN1; (+) strand; PAM type: YTN; PAM sequence: TTG
ccatgtttttggcttaactg

SEQ ID NO: 311793 - DNA, 20 bp, Artificial Sequence
  Description of Artificial Sequence: Synthetic oligonucleotide
  Target: ATXN1; (+) strand; PAM type: YTN; PAM sequence: TTT
ttggcttaactgcgatgttt

SEQ ID NO: 311794 - DNA, 20 bp, Artificial Sequence
  Description of Artificial Sequence: Synthetic oligonucleotide
  Target: ATXN1; (+) strand; PAM type: YTN; PAM sequence: TTT
tggcttaactgcgatgtttt

SEQ ID NO: 311795 - DNA, 20 bp, Artificial Sequence
  Description of Artificial Sequence: Synthetic oligonucleotide
  Target: ATXN1; (+) strand; PAM type: YTN; PAM sequence: TTT
ggcttaactgcgatgttttt

SEQ ID NO: 311796 - DNA, 20 bp, Artificial Sequence
  Description of Artificial Sequence: Synthetic oligonucleotide
  Target: ATXN1; (+) strand; PAM type: YTN; PAM sequence: TTG
gcttaactgcgatgttttta

SEQ ID NO: 311797 - DNA, 20 bp, Artificial Sequence
  Description of Artificial Sequence: Synthetic oligonucleotide
  Target: ATXN1; (+) strand; PAM type: YTN; PAM sequence: CTT
aactgcgatgtttttattcc

SEQ ID NO: 311798 - DNA, 20 bp, Artificial Sequence
  Description of Artificial Sequence: Synthetic oligonucleotide
  Target: ATXN1; (+) strand; PAM type: YTN; PAM sequence: TTA
actgcgatgtttttattcca

SEQ ID NO: 311799 - DNA, 20 bp, Artificial Sequence
  Description of Artificial Sequence: Synthetic oligonucleotide
  Target: ATXN1; (+) strand; PAM type: YTN; PAM sequence: CTG
cgatgtttttattccaactc

SEQ ID NO: 311800 - DNA, 20 bp, Artificial Sequence
  Description of Artificial Sequence: Synthetic oligonucleotide
  Target: ATXN1; (+) strand; PAM type: YTN; PAM sequence: TTT
ttattccaactcataatctg

SEQ ID NO: 311801 - DNA, 20 bp, Artificial Sequence
  Description of Artificial Sequence: Synthetic oligonucleotide
  Target: ATXN1; (+) strand; PAM type: YTN; PAM sequence: TTT
tattccaactcataatctgc

SEQ ID NO: 311802 - DNA, 20 bp, Artificial Sequence
  Description of Artificial Sequence: Synthetic oligonucleotide
  Target: ATXN1; (+) strand; PAM type: YTN; PAM sequence: TTT
attccaactcataatctgca

SEQ ID NO: 311803 - DNA, 20 bp, Artificial Sequence
  Description of Artificial Sequence: Synthetic oligonucleotide
  Target: ATXN1; (+) strand; PAM type: YTN; PAM sequence: TTA
ttccaactcataatctgcaa

SEQ ID NO: 311804 - DNA, 20 bp, Artificial Sequence
  Description of Artificial Sequence: Synthetic oligonucleotide
  Target: ATXN1; (+) strand; PAM type: YTN; PAM sequence: TTC
caactcataatctgcaaact

SEQ ID NO: 311805 - DNA, 20 bp, Artificial Sequence
  Description of Artificial Sequence: Synthetic oligonucleotide
  Target: ATXN1; (+) strand; PAM type: YTN; PAM sequence: CTC
ataatctgcaaactgtccaa

SEQ ID NO: 311806 - DNA, 20 bp, Artificial Sequence
  Description of Artificial Sequence: Synthetic oligonucleotide
  Target: ATXN1; (+) strand; PAM type: YTN; PAM sequence: CTG
caaactgtccaatccacctc

SEQ ID NO: 311807 - DNA, 20 bp, Artificial Sequence
  Description of Artificial Sequence: Synthetic oligonucleotide
  Target: ATXN1; (+) strand; PAM type: YTN; PAM sequence: CTG
tccaatccacctccactcta

SEQ ID NO: 311808 - DNA, 20 bp, Artificial Sequence
  Description of Artificial Sequence: Synthetic oligonucleotide
  Target: ATXN1; (+) strand; PAM type: YTN; PAM sequence: CTC
cactctatttttagacatct

SEQ ID NO: 311809 - DNA, 20 bp, Artificial Sequence
  Description of Artificial Sequence: Synthetic oligonucleotide
  Target: ATXN1; (+) strand; PAM type: YTN; PAM sequence: CTC
tatttttagacatcttacat

SEQ ID NO: 311810 - DNA, 20 bp, Artificial Sequence
  Description of Artificial Sequence: Synthetic oligonucleotide
  Target: ATXN1; (+) strand; PAM type: YTN; PAM sequence: CTA
tttttagacatcttacattt

SEQ ID NO: 311811 - DNA, 20 bp, Artificial Sequence
  Description of Artificial Sequence: Synthetic oligonucleotide
  Target: ATXN1; (+) strand; PAM type: YTN; PAM sequence: TTT
ttagacatcttacatttaga

SEQ ID NO: 311812 - DNA, 20 bp, Artificial Sequence
  Description of Artificial Sequence: Synthetic oligonucleotide
  Target: ATXN1; (+) strand; PAM type: YTN; PAM sequence: TTT
tagacatcttacatttagat

SEQ ID NO: 311813 - DNA, 20 bp, Artificial Sequence
  Description of Artificial Sequence: Synthetic oligonucleotide
  Target: ATXN1; (+) strand; PAM type: YTN; PAM sequence: TTT
agacatcttacatttagata

SEQ ID NO: 311814 - DNA, 20 bp, Artificial Sequence
  Description of Artificial Sequence: Synthetic oligonucleotide
  Target: ATXN1; (+) strand; PAM type: YTN; PAM sequence: TTA
gacatcttacatttagataa

SEQ ID NO: 311815 - DNA, 20 bp, Artificial Sequence
  Description of Artificial Sequence: Synthetic oligonucleotide
  Target: ATXN1; (+) strand; PAM type: YTN; PAM sequence: CTT
acatttagataattttcagt

SEQ ID NO: 311816 - DNA, 20 bp, Artificial Sequence
  Description of Artificial Sequence: Synthetic oligonucleotide
  Target: ATXN1; (+) strand; PAM type: YTN; PAM sequence: TTA
catttagataattttcagtt

SEQ ID NO: 311817 - DNA, 20 bp, Artificial Sequence
  Description of Artificial Sequence: Synthetic oligonucleotide
  Target: ATXN1; (+) strand; PAM type: YTN; PAM sequence: TTT
agataattttcagttaaaaa

SEQ ID NO: 311818 - DNA, 20 bp, Artificial Sequence
  Description of Artificial Sequence: Synthetic oligonucleotide
  Target: ATXN1; (+) strand; PAM type: YTN; PAM sequence: TTA
gataattttcagttaaaaaa

SEQ ID NO: 311819 - DNA, 20 bp, Artificial Sequence
  Description of Artificial Sequence: Synthetic oligonucleotide
  Target: ATXN1; (+) strand; PAM type: YTN; PAM sequence: TTT
tcagttaaaaaaaagctaat

SEQ ID NO: 311820 - DNA, 20 bp, Artificial Sequence
  Description of Artificial Sequence: Synthetic oligonucleotide
  Target: ATXN1; (+) strand; PAM type: YTN; PAM sequence: TTT
cagttaaaaaaaagctaata

SEQ ID NO: 311821 - DNA, 20 bp, Artificial Sequence
  Description of Artificial Sequence: Synthetic oligonucleotide
  Target: ATXN1; (+) strand; PAM type: YTN; PAM sequence: TTC
agttaaaaaaaagctaatat

SEQ ID NO: 311822 - DNA, 20 bp, Artificial Sequence
  Description of Artificial Sequence: Synthetic oligonucleotide
  Target: ATXN1; (+) strand; PAM type: YTN; PAM sequence: TTA
aaaaaaagctaatattgtaa

SEQ ID NO: 311823 - DNA, 20 bp, Artificial Sequence
  Description of Artificial Sequence: Synthetic oligonucleotide
  Target: ATXN1; (+) strand; PAM type: YTN; PAM sequence: CTA
atattgtaattttacgttgg

SEQ ID NO: 311824 - DNA, 20 bp, Artificial Sequence
  Description of Artificial Sequence: Synthetic oligonucleotide
  Target: ATXN1; (+) strand; PAM type: YTN; PAM sequence: TTG
taattttacgttggcacaag

SEQ ID NO: 311825 - DNA, 20 bp, Artificial Sequence
  Description of Artificial Sequence: Synthetic oligonucleotide
  Target: ATXN1; (+) strand; PAM type: YTN; PAM sequence: TTT
tacgttggcacaagcagtta

SEQ ID NO: 311826 - DNA, 20 bp, Artificial Sequence
  Description of Artificial Sequence: Synthetic oligonucleotide
  Target: ATXN1; (+) strand; PAM type: YTN; PAM sequence: TTT
acgttggcacaagcagttaa

SEQ ID NO: 311827 - DNA, 20 bp, Artificial Sequence
  Description of Artificial Sequence: Synthetic oligonucleotide
  Target: ATXN1; (+) strand; PAM type: YTN; PAM sequence: TTA
cgttggcacaagcagttaat

SEQ ID NO: 311828 - DNA, 20 bp, Artificial Sequence
  Description of Artificial Sequence: Synthetic oligonucleotide
  Target: ATXN1; (+) strand; PAM type: YTN; PAM sequence: TTG
gcacaagcagttaatttacg

SEQ ID NO: 311829 - DNA, 20 bp, Artificial Sequence
  Description of Artificial Sequence: Synthetic oligonucleotide
  Target: ATXN1; (+) strand; PAM type: YTN; PAM sequence: TTA
atttacgtgattttaacaac

SEQ ID NO: 311830 - DNA, 20 bp, Artificial Sequence
  Description of Artificial Sequence: Synthetic oligonucleotide
  Target: ATXN1; (+) strand; PAM type: YTN; PAM sequence: TTT
acgtgattttaacaacctta

SEQ ID NO: 311831 - DNA, 20 bp, Artificial Sequence
  Description of Artificial Sequence: Synthetic oligonucleotide
  Target: ATXN1; (+) strand; PAM type: YTN; PAM sequence: TTA
cgtgattttaacaaccttaa

SEQ ID NO: 311832 - DNA, 20 bp, Artificial Sequence
  Description of Artificial Sequence: Synthetic oligonucleotide
  Target: ATXN1; (+) strand; PAM type: YTN; PAM sequence: TTT
taacaaccttaaattaaaac

SEQ ID NO: 311833 - DNA, 20 bp, Artificial Sequence
  Description of Artificial Sequence: Synthetic oligonucleotide
  Target: ATXN1; (+) strand; PAM type: YTN; PAM sequence: TTT
aacaaccttaaattaaaaca

SEQ ID NO: 311834 - DNA, 20 bp, Artificial Sequence
  Description of Artificial Sequence: Synthetic oligonucleotide
  Target: ATXN1; (+) strand; PAM type: YTN; PAM sequence: TTA
acaaccttaaattaaaacac

SEQ ID NO: 311835 - DNA, 20 bp, Artificial Sequence
  Description of Artificial Sequence: Synthetic oligonucleotide
  Target: ATXN1; (+) strand; PAM type: YTN; PAM sequence: CTT
aaattaaaacacataattca

SEQ ID NO: 311836 - DNA, 20 bp, Artificial Sequence
  Description of Artificial Sequence: Synthetic oligonucleotide
  Target: ATXN1; (+) strand; PAM type: YTN; PAM sequence: TTA
aattaaaacacataattcag

SEQ ID NO: 311837 - DNA, 20 bp, Artificial Sequence
  Description of Artificial Sequence: Synthetic oligonucleotide
  Target: ATXN1; (+) strand; PAM type: YTN; PAM sequence: TTA
aaacacataattcagattac

SEQ ID NO: 311838 - DNA, 20 bp, Artificial Sequence
  Description of Artificial Sequence: Synthetic oligonucleotide
  Target: ATXN1; (+) strand; PAM type: YTN; PAM sequence: TTC
agattacagttagtcaatta

SEQ ID NO: 311839 - DNA, 20 bp, Artificial Sequence
  Description of Artificial Sequence: Synthetic oligonucleotide
  Target: ATXN1; (+) strand; PAM type: YTN; PAM sequence: TTA
cagttagtcaattaatttaa

SEQ ID NO: 311840 - DNA, 20 bp, Artificial Sequence
  Description of Artificial Sequence: Synthetic oligonucleotide
  Target: ATXN1; (+) strand; PAM type: YTN; PAM sequence: TTA
gtcaattaatttaaatgttc

SEQ ID NO: 311841 - DNA, 20 bp, Artificial Sequence
  Description of Artificial Sequence: Synthetic oligonucleotide
  Target: ATXN1; (+) strand; PAM type: YTN; PAM sequence: TTA
atttaaatgttctctcaagg

SEQ ID NO: 311842 - DNA, 20 bp, Artificial Sequence
  Description of Artificial Sequence: Synthetic oligonucleotide
  Target: ATXN1; (+) strand; PAM type: YTN; PAM sequence: TTT
aaatgttctctcaaggaagc

SEQ ID NO: 311843 - DNA, 20 bp, Artificial Sequence
  Description of Artificial Sequence: Synthetic oligonucleotide
  Target: ATXN1; (+) strand; PAM type: YTN; PAM sequence: TTA
aatgttctctcaaggaagct

SEQ ID NO: 311844 - DNA, 20 bp, Artificial Sequence
  Description of Artificial Sequence: Synthetic oligonucleotide
  Target: ATXN1; (+) strand; PAM type: YTN; PAM sequence: TTC
tctcaaggaagctaaatatg

SEQ ID NO: 311845 - DNA, 20 bp, Artificial Sequence
  Description of Artificial Sequence: Synthetic oligonucleotide
  Target: ATXN1; (+) strand; PAM type: YTN; PAM sequence: CTC
tcaaggaagctaaatatgta

SEQ ID NO: 311846 - DNA, 20 bp, Artificial Sequence
  Description of Artificial Sequence: Synthetic oligonucleotide
  Target: ATXN1; (+) strand; PAM type: YTN; PAM sequence: CTC
aaggaagctaaatatgtata

SEQ ID NO: 311847 - DNA, 20 bp, Artificial Sequence
  Description of Artificial Sequence: Synthetic oligonucleotide
  Target: ATXN1; (+) strand; PAM type: YTN; PAM sequence: CTA
aatatgtatattacccaaat

SEQ ID NO: 311848 - DNA, 20 bp, Artificial Sequence
  Description of Artificial Sequence: Synthetic oligonucleotide
  Target: ATXN1; (+) strand; PAM type: YTN; PAM sequence: TTA
cccaaatggtaaaaacaatt

SEQ ID NO: 311849 - DNA, 20 bp, Artificial Sequence
  Description of Artificial Sequence: Synthetic oligonucleotide
  Target: ATXN1; (+) strand; PAM type: YTN; PAM sequence: TTA
ataagaaatgtgtcatttac

SEQ ID NO: 311850 - DNA, 20 bp, Artificial Sequence
  Description of Artificial Sequence: Synthetic oligonucleotide
  Target: ATXN1; (+) strand; PAM type: YTN; PAM sequence: TTT
actttcttagccattaagtt

SEQ ID NO: 311851 - DNA, 20 bp, Artificial Sequence
  Description of Artificial Sequence: Synthetic oligonucleotide
  Target: ATXN1; (+) strand; PAM type: YTN; PAM sequence: TTA
ctttcttagccattaagttt

SEQ ID NO: 311852 - DNA, 20 bp, Artificial Sequence
  Description of Artificial Sequence: Synthetic oligonucleotide
  Target: ATXN1; (+) strand; PAM type: YTN; PAM sequence: CTT
tcttagccattaagtttaaa

SEQ ID NO: 311853 - DNA, 20 bp, Artificial Sequence
  Description of Artificial Sequence: Synthetic oligonucleotide
  Target: ATXN1; (+) strand; PAM type: YTN; PAM sequence: TTT
cttagccattaagtttaaag

SEQ ID NO: 311854 - DNA, 20 bp, Artificial Sequence
  Description of Artificial Sequence: Synthetic oligonucleotide
  Target: ATXN1; (+) strand; PAM type: YTN; PAM sequence: TTC
ttagccattaagtttaaagc

SEQ ID NO: 311855 - DNA, 20 bp, Artificial Sequence
  Description of Artificial Sequence: Synthetic oligonucleotide
  Target: ATXN1; (+) strand; PAM type: YTN; PAM sequence: CTT
agccattaagtttaaagcca

SEQ ID NO: 311856 - DNA, 20 bp, Artificial Sequence
  Description of Artificial Sequence: Synthetic oligonucleotide
  Target: ATXN1; (+) strand; PAM type: YTN; PAM sequence: TTA
gccattaagtttaaagccat

SEQ ID NO: 311857 - DNA, 20 bp, Artificial Sequence
  Description of Artificial Sequence: Synthetic oligonucleotide
  Target: ATXN1; (+) strand; PAM type: YTN; PAM sequence: TTA
agtttaaagccataaactgc

SEQ ID NO: 311858 - DNA, 20 bp, Artificial Sequence
  Description of Artificial Sequence: Synthetic oligonucleotide
  Target: ATXN1; (+) strand; PAM type: YTN; PAM sequence: TTT
aaagccataaactgccacca

SEQ ID NO: 311859 - DNA, 20 bp, Artificial Sequence
  Description of Artificial Sequence: Synthetic oligonucleotide
  Target: ATXN1; (+) strand; PAM type: YTN; PAM sequence: TTA
aagccataaactgccaccaa

SEQ ID NO: 311860 - DNA, 20 bp, Artificial Sequence
  Description of Artificial Sequence: Synthetic oligonucleotide
  Target: ATXN1; (+) strand; PAM type: YTN; PAM sequence: CTG
ccaccaaaatctgtaactat

SEQ ID NO: 311861 - DNA, 20 bp, Artificial Sequence
  Description of Artificial Sequence: Synthetic oligonucleotide
  Target: ATXN1; (+) strand; PAM type: YTN; PAM sequence: CTG
taactatttcttcctgcaag

SEQ ID NO: 311862 - DNA, 20 bp, Artificial Sequence
  Description of Artificial Sequence: Synthetic oligonucleotide
  Target: ATXN1; (+) strand; PAM type: YTN; PAM sequence: CTA
tttcttcctgcaagatccaa

SEQ ID NO: 311863 - DNA, 20 bp, Artificial Sequence
  Description of Artificial Sequence: Synthetic oligonucleotide
  Target: ATXN1; (+) strand; PAM type: YTN; PAM sequence: TTT
cttcctgcaagatccaacat

SEQ ID NO: 311864 - DNA, 20 bp, Artificial Sequence
  Description of Artificial Sequence: Synthetic oligonucleotide
  Target: ATXN1; (+) strand; PAM type: YTN; PAM sequence: TTC
ttcctgcaagatccaacata

SEQ ID NO: 311865 - DNA, 20 bp, Artificial Sequence
  Description of Artificial Sequence: Synthetic oligonucleotide
  Target: ATXN1; (+) strand; PAM type: YTN; PAM sequence: CTT
cctgcaagatccaacataaa

SEQ ID NO: 311866 - DNA, 20 bp, Artificial Sequence
  Description of Artificial Sequence: Synthetic oligonucleotide
  Target: ATXN1; (+) strand; PAM type: YTN; PAM sequence: TTC
ctgcaagatccaacataaac

SEQ ID NO: 311867 - DNA, 20 bp, Artificial Sequence
  Description of Artificial Sequence: Synthetic oligonucleotide
  Target: ATXN1; (+) strand; PAM type: YTN; PAM sequence: CTG
caagatccaacataaacacc

SEQ ID NO: 311868 - DNA, 20 bp, Artificial Sequence
  Description of Artificial Sequence: Synthetic oligonucleotide
  Target: ATXN1; (+) strand; PAM type: YTN; PAM sequence: CTC
atgaaactgtctcattacct

SEQ ID NO: 311869 - DNA, 20 bp, Artificial Sequence
  Description of Artificial Sequence: Synthetic oligonucleotide
  Target: ATXN1; (+) strand; PAM type: YTN; PAM sequence: CTG
tctcattacctttagtactg

SEQ ID NO: 311870 - DNA, 20 bp, Artificial Sequence
  Description of Artificial Sequence: Synthetic oligonucleotide
  Target: ATXN1; (+) strand; PAM type: YTN; PAM sequence: CTC
attacctttagtactgaaat

SEQ ID NO: 311871 - DNA, 20 bp, Artificial Sequence
  Description of Artificial Sequence: Synthetic oligonucleotide
  Target: ATXN1; (+) strand; PAM type: YTN; PAM sequence: TTA
cctttagtactgaaatattt

SEQ ID NO: 311872 - DNA, 20 bp, Artificial Sequence
  Description of Artificial Sequence: Synthetic oligonucleotide
  Target: ATXN1; (+) strand; PAM type: YTN; PAM sequence: CTT
tagtactgaaatattttgtt

SEQ ID NO: 311873 - DNA, 20 bp, Artificial Sequence
  Description of Artificial Sequence: Synthetic oligonucleotide
  Target: ATXN1; (+) strand; PAM type: YTN; PAM sequence: TTT
agtactgaaatattttgttt

SEQ ID NO: 311874 - DNA, 20 bp, Artificial Sequence
  Description of Artificial Sequence: Synthetic oligonucleotide
  Target: ATXN1; (+) strand; PAM type: YTN; PAM sequence: TTA
gtactgaaatattttgtttt

SEQ ID NO: 311875 - DNA, 20 bp, Artificial Sequence
  Description of Artificial Sequence: Synthetic oligonucleotide
  Target: ATXN1; (+) strand; PAM type: YTN; PAM sequence: CTG
aaatattttgttttcagatg

SEQ ID NO: 311876 - DNA, 20 bp, Artificial Sequence
  Description of Artificial Sequence: Synthetic oligonucleotide
  Target: ATXN1; (+) strand; PAM type: YTN; PAM sequence: TTT
tgttttcagatggcaaaata

SEQ ID NO: 311877 - DNA, 20 bp, Artificial Sequence
  Description of Artificial Sequence: Synthetic oligonucleotide
  Target: ATXN1; (+) strand; PAM type: YTN; PAM sequence: TTT
gttttcagatggcaaaatat

SEQ ID NO: 311878 - DNA, 20 bp, Artificial Sequence
  Description of Artificial Sequence: Synthetic oligonucleotide
  Target: ATXN1; (+) strand; PAM type: YTN; PAM sequence: TTG
ttttcagatggcaaaatatt

SEQ ID NO: 311879 - DNA, 20 bp, Artificial Sequence
  Description of Artificial Sequence: Synthetic oligonucleotide
  Target: ATXN1; (+) strand; PAM type: YTN; PAM sequence: TTT
tcagatggcaaaatattaag

SEQ ID NO: 311880 - DNA, 20 bp, Artificial Sequence
  Description of Artificial Sequence: Synthetic oligonucleotide
  Target: ATXN1; (+) strand; PAM type: YTN; PAM sequence: TTT
cagatggcaaaatattaagt

SEQ ID NO: 311881 - DNA, 20 bp, Artificial Sequence
  Description of Artificial Sequence: Synthetic oligonucleotide
  Target: ATXN1; (+) strand; PAM type: YTN; PAM sequence: TTC
agatggcaaaatattaagtg

SEQ ID NO: 311882 - DNA, 20 bp, Artificial Sequence
  Description of Artificial Sequence: Synthetic oligonucleotide
  Target: ATXN1; (+) strand; PAM type: YTN; PAM sequence: TTA
agtgtacaatcacaaataac

SEQ ID NO: 311883 - DNA, 20 bp, Artificial Sequence
  Description of Artificial Sequence: Synthetic oligonucleotide
  Target: ATXN1; (+) strand; PAM type: YTN; PAM sequence: CTG
attctttagaaacaagactt

SEQ ID NO: 311884 - DNA, 20 bp, Artificial Sequence
  Description of Artificial Sequence: Synthetic oligonucleotide
  Target: ATXN1; (+) strand; PAM type: YTN; PAM sequence: TTC
tttagaaacaagactttctc

SEQ ID NO: 311885 - DNA, 20 bp, Artificial Sequence
  Description of Artificial Sequence: Synthetic oligonucleotide
  Target: ATXN1; (+) strand; PAM type: YTN; PAM sequence: CTT
tagaaacaagactttctcgt

SEQ ID NO: 311886 - DNA, 20 bp, Artificial Sequence
  Description of Artificial Sequence: Synthetic oligonucleotide
  Target: ATXN1; (+) strand; PAM type: YTN; PAM sequence: TTT
agaaacaagactttctcgtg

SEQ ID NO: 311887 - DNA, 20 bp, Artificial Sequence
  Description of Artificial Sequence: Synthetic oligonucleotide
  Target: ATXN1; (+) strand; PAM type: YTN; PAM sequence: TTA
gaaacaagactttctcgtgc

SEQ ID NO: 311888 - DNA, 20 bp, Artificial Sequence
  Description of Artificial Sequence: Synthetic oligonucleotide
  Target: ATXN1; (+) strand; PAM type: YTN; PAM sequence: CTT
tctcgtgcaaataaaaactc

SEQ ID NO: 311889 - DNA, 20 bp, Artificial Sequence
  Description of Artificial Sequence: Synthetic oligonucleotide
  Target: ATXN1; (+) strand; PAM type: YTN; PAM sequence: TTT
ctcgtgcaaataaaaactca

SEQ ID NO: 311890 - DNA, 20 bp, Artificial Sequence
  Description of Artificial Sequence: Synthetic oligonucleotide
  Target: ATXN1; (+) strand; PAM type: YTN; PAM sequence: TTC
tcgtgcaaataaaaactcaa

SEQ ID NO: 311891 - DNA, 20 bp, Artificial Sequence
  Description of Artificial Sequence: Synthetic oligonucleotide
  Target: ATXN1; (+) strand; PAM type: YTN; PAM sequence: CTC
gtgcaaataaaaactcaatg

SEQ ID NO: 311892 - DNA, 20 bp, Artificial Sequence
  Description of Artificial Sequence: Synthetic oligonucleotide
  Target: ATXN1; (+) strand; PAM type: YTN; PAM sequence: CTC
aatgaaaaagggcagagctt

SEQ ID NO: 311893 - DNA, 20 bp, Artificial Sequence
  Description of Artificial Sequence: Synthetic oligonucleotide
  Target: ATXN1; (+) strand; PAM type: YTN; PAM sequence: CTT
ccaagaagctagtagacaaa

SEQ ID NO: 311894 - DNA, 20 bp, Artificial Sequence
  Description of Artificial Sequence: Synthetic oligonucleotide
  Target: ATXN1; (+) strand; PAM type: YTN; PAM sequence: TTC
caagaagctagtagacaaat

SEQ ID NO: 311895 - DNA, 20 bp, Artificial Sequence
  Description of Artificial Sequence: Synthetic oligonucleotide
  Target: ATXN1; (+) strand; PAM type: YTN; PAM sequence: CTA
gtagacaaatatatagtact

SEQ ID NO: 311896 - DNA, 20 bp, Artificial Sequence
  Description of Artificial Sequence: Synthetic oligonucleotide
  Target: ATXN1; (+) strand; PAM type: YTN; PAM sequence: CTA
tagtcctactcataaggctg

SEQ ID NO: 311897 - DNA, 20 bp, Artificial Sequence
  Description of Artificial Sequence: Synthetic oligonucleotide
  Target: ATXN1; (+) strand; PAM type: YTN; PAM sequence: CTA
ctcataaggctggtgttatg

SEQ ID NO: 311898 - DNA, 20 bp, Artificial Sequence
  Description of Artificial Sequence: Synthetic oligonucleotide
  Target: ATXN1; (+) strand; PAM type: YTN; PAM sequence: CTC
ataaggctggtgttatgttt

SEQ ID NO: 311899 - DNA, 20 bp, Artificial Sequence
  Description of Artificial Sequence: Synthetic oligonucleotide
  Target: ATXN1; (+) strand; PAM type: YTN; PAM sequence: CTG
gtgttatgtttgtaaaagca

SEQ ID NO: 311900 - DNA, 20 bp, Artificial Sequence
  Description of Artificial Sequence: Synthetic oligonucleotide
  Target: ATXN1; (+) strand; PAM type: YTN; PAM sequence: TTA
tgtttgtaaaagcataagtc

SEQ ID NO: 311901 - DNA, 20 bp, Artificial Sequence
  Description of Artificial Sequence: Synthetic oligonucleotide
  Target: ATXN1; (+) strand; PAM type: YTN; PAM sequence: TTT
gtaaaagcataagtcaacct

SEQ ID NO: 311902 - DNA, 20 bp, Artificial Sequence
  Description of Artificial Sequence: Synthetic oligonucleotide
  Target: ATXN1; (+) strand; PAM type: YTN; PAM sequence: TTG
taaaagcataagtcaacctt

SEQ ID NO: 311903 - DNA, 20 bp, Artificial Sequence
  Description of Artificial Sequence: Synthetic oligonucleotide
  Target: ATXN1; (+) strand; PAM type: YTN; PAM sequence: CTT
tgaaattacaggaaatcgat

SEQ ID NO: 311904 - DNA, 20 bp, Artificial Sequence
  Description of Artificial Sequence: Synthetic oligonucleotide
  Target: ATXN1; (+) strand; PAM type: YTN; PAM sequence: TTT
gaaattacaggaaatcgata

SEQ ID NO: 311905 - DNA, 20 bp, Artificial Sequence
  Description of Artificial Sequence: Synthetic oligonucleotide
  Target: ATXN1; (+) strand; PAM type: YTN; PAM sequence: TTG
aaattacaggaaatcgataa

SEQ ID NO: 311906 - DNA, 20 bp, Artificial Sequence
  Description of Artificial Sequence: Synthetic oligonucleotide
  Target: ATXN1; (+) strand; PAM type: YTN; PAM sequence: TTA
caggaaatcgataaataagg

SEQ ID NO: 311907 - DNA, 20 bp, Artificial Sequence
  Description of Artificial Sequence: Synthetic oligonucleotide
  Target: ATXN1; (+) strand; PAM type: YTN; PAM sequence: CTG
atgagcttgactcgtatcct

SEQ ID NO: 311908 - DNA, 20 bp, Artificial Sequence
  Description of Artificial Sequence: Synthetic oligonucleotide
  Target: ATXN1; (+) strand; PAM type: YTN; PAM sequence: CTT
gactcgtatcctgtgtcata

SEQ ID NO: 311909 - DNA, 20 bp, Artificial Sequence
  Description of Artificial Sequence: Synthetic oligonucleotide
  Target: ATXN1; (+) strand; PAM type: YTN; PAM sequence: TTG
actcgtatcctgtgtcatag

SEQ ID NO: 311910 - DNA, 20 bp, Artificial Sequence
  Description of Artificial Sequence: Synthetic oligonucleotide
  Target: ATXN1; (+) strand; PAM type: YTN; PAM sequence: CTC
gtatcctgtgtcatagattg

SEQ ID NO: 311911 - DNA, 20 bp, Artificial Sequence
  Description of Artificial Sequence: Synthetic oligonucleotide
  Target: ATXN1; (+) strand; PAM type: YTN; PAM sequence: CTG
tgtcatagattgcttaaata

SEQ ID NO: 311912 - DNA, 20 bp, Artificial Sequence
  Description of Artificial Sequence: Synthetic oligonucleotide
  Target: ATXN1; (+) strand; PAM type: YTN; PAM sequence: TTG
cttaaataccatgaaaaata

SEQ ID NO: 311913 - DNA, 20 bp, Artificial Sequence
  Description of Artificial Sequence: Synthetic oligonucleotide
  Target: ATXN1; (+) strand; PAM type: YTN; PAM sequence: CTT
aaataccatgaaaaataatt

SEQ ID NO: 311914 - DNA, 20 bp, Artificial Sequence
  Description of Artificial Sequence: Synthetic oligonucleotide
  Target: ATXN1; (+) strand; PAM type: YTN; PAM sequence: TTA
aataccatgaaaaataattg

SEQ ID NO: 311915 - DNA, 20 bp, Artificial Sequence
  Description of Artificial Sequence: Synthetic oligonucleotide
  Target: ATXN1; (+) strand; PAM type: YTN; PAM sequence: TTG
taatcacatatctattttac

SEQ ID NO: 311916 - DNA, 20 bp, Artificial Sequence
  Description of Artificial Sequence: Synthetic oligonucleotide
  Target: ATXN1; (+) strand; PAM type: YTN; PAM sequence: CTA
ttttactgttttggtggtat

SEQ ID NO: 311917 - DNA, 20 bp, Artificial Sequence
  Description of Artificial Sequence: Synthetic oligonucleotide
  Target: ATXN1; (+) strand; PAM type: YTN; PAM sequence: TTT
tactgttttggtggtatcta

SEQ ID NO: 311918 - DNA, 20 bp, Artificial Sequence
  Description of Artificial Sequence: Synthetic oligonucleotide
  Target: ATXN1; (+) strand; PAM type: YTN; PAM sequence: TTT
actgttttggtggtatctac

SEQ ID NO: 311919 - DNA, 20 bp, Artificial Sequence
  Description of Artificial Sequence: Synthetic oligonucleotide
  Target: ATXN1; (+) strand; PAM type: YTN; PAM sequence: TTA
ctgttttggtggtatctact

SEQ ID NO: 311920 - DNA, 20 bp, Artificial Sequence
  Description of Artificial Sequence: Synthetic oligonucleotide
  Target: ATXN1; (+) strand; PAM type: YTN; PAM sequence: CTG
ttttggtggtatctactctt

SEQ ID NO: 311921 - DNA, 20 bp, Artificial Sequence
  Description of Artificial Sequence: Synthetic oligonucleotide
  Target: ATXN1; (+) strand; PAM type: YTN; PAM sequence: TTT
tggtggtatctactcttgaa

SEQ ID NO: 311922 - DNA, 20 bp, Artificial Sequence
  Description of Artificial Sequence: Synthetic oligonucleotide
  Target: ATXN1; (+) strand; PAM type: YTN; PAM sequence: TTT
ggtggtatctactcttgaag

SEQ ID NO: 311923 - DNA, 20 bp, Artificial Sequence
  Description of Artificial Sequence: Synthetic oligonucleotide
  Target: ATXN1; (+) strand; PAM type: YTN; PAM sequence: TTG
gtggtatctactcttgaagg

SEQ ID NO: 311924 - DNA, 20 bp, Artificial Sequence
  Description of Artificial Sequence: Synthetic oligonucleotide
  Target: ATXN1; (+) strand; PAM type: YTN; PAM sequence: CTA
ctcttgaaggtgttaaatgg

SEQ ID NO: 311925 - DNA, 20 bp, Artificial Sequence
  Description of Artificial Sequence: Synthetic oligonucleotide
  Target: ATXN1; (+) strand; PAM type: YTN; PAM sequence: CTC
ttgaaggtgttaaatgggcc

SEQ ID NO: 311926 - DNA, 20 bp, Artificial Sequence
  Description of Artificial Sequence: Synthetic oligonucleotide
  Target: ATXN1; (+) strand; PAM type: YTN; PAM sequence: CTT
gaaggtgttaaatgggccag

SEQ ID NO: 311927 - DNA, 20 bp, Artificial Sequence
  Description of Artificial Sequence: Synthetic oligonucleotide
  Target: ATXN1; (+) strand; PAM type: YTN; PAM sequence: TTG
aaggtgttaaatgggccagc

SEQ ID NO: 311928 - DNA, 20 bp, Artificial Sequence
  Description of Artificial Sequence: Synthetic oligonucleotide
  Target: ATXN1; (+) strand; PAM type: YTN; PAM sequence: TTA
aatgggccagcaagtatata

SEQ ID NO: 311929 - DNA, 20 bp, Artificial Sequence
  Description of Artificial Sequence: Synthetic oligonucleotide
  Target: ATXN1; (+) strand; PAM type: YTN; PAM sequence: TTA
tataattacatattacaccc

SEQ ID NO: 311930 - DNA, 20 bp, Artificial Sequence
  Description of Artificial Sequence: Synthetic oligonucleotide
  Target: ATXN1; (+) strand; PAM type: YTN; PAM sequence: TTA
catattacacccttacttaa

SEQ ID NO: 311931 - DNA, 20 bp, Artificial Sequence
  Description of Artificial Sequence: Synthetic oligonucleotide
  Target: ATXN1; (+) strand; PAM type: YTN; PAM sequence: TTA
cacccttacttaaagtgtag

SEQ ID NO: 311932 - DNA, 20 bp, Artificial Sequence
  Description of Artificial Sequence: Synthetic oligonucleotide
  Target: ATXN1; (+) strand; PAM type: YTN; PAM sequence: CTT
acttaaagtgtagttttcaa

SEQ ID NO: 311933 - DNA, 20 bp, Artificial Sequence
  Description of Artificial Sequence: Synthetic oligonucleotide
  Target: ATXN1; (+) strand; PAM type: YTN; PAM sequence: TTA
cttaaagtgtagttttcaaa

SEQ ID NO: 311934 - DNA, 20 bp, Artificial Sequence
  Description of Artificial Sequence: Synthetic oligonucleotide
  Target: ATXN1; (+) strand; PAM type: YTN; PAM sequence: CTT
aaagtgtagttttcaaagtc

SEQ ID NO: 311935 - DNA, 20 bp, Artificial Sequence
  Description of Artificial Sequence: Synthetic oligonucleotide
  Target: ATXN1; (+) strand; PAM type: YTN; PAM sequence: TTA
aagtgtagttttcaaagtcg

SEQ ID NO: 311936 - DNA, 20 bp, Artificial Sequence
  Description of Artificial Sequence: Synthetic oligonucleotide
  Target: ATXN1; (+) strand; PAM type: YTN; PAM sequence: TTT
tcaaagtcgccacagcagca

SEQ ID NO: 311937 - DNA, 20 bp, Artificial Sequence
  Description of Artificial Sequence: Synthetic oligonucleotide
  Target: ATXN1; (+) strand; PAM type: YTN; PAM sequence: TTT
caaagtcgccacagcagcac

SEQ ID NO: 311938 - DNA, 20 bp, Artificial Sequence
  Description of Artificial Sequence: Synthetic oligonucleotide
  Target: ATXN1; (+) strand; PAM type: YTN; PAM sequence: TTC
aaagtcgccacagcagcact

SEQ ID NO: 311939 - DNA, 20 bp, Artificial Sequence
  Description of Artificial Sequence: Synthetic oligonucleotide
  Target: ATXN1; (+) strand; PAM type: YTN; PAM sequence: CTT
gggagctttttagacattca

SEQ ID NO: 311940 - DNA, 20 bp, Artificial Sequence
  Description of Artificial Sequence: Synthetic oligonucleotide
  Target: ATXN1; (+) strand; PAM type: YTN; PAM sequence: TTG
ggagctttttagacattcag

SEQ ID NO: 311941 - DNA, 20 bp, Artificial Sequence
  Description of Artificial Sequence: Synthetic oligonucleotide
  Target: ATXN1; (+) strand; PAM type: YTN; PAM sequence: CTT
tttagacattcagagtcaag

SEQ ID NO: 311942 - DNA, 20 bp, Artificial Sequence
  Description of Artificial Sequence: Synthetic oligonucleotide
  Target: ATXN1; (+) strand; PAM type: YTN; PAM sequence: TTT
ttagacattcagagtcaagg

SEQ ID NO: 311943 - DNA, 20 bp, Artificial Sequence
  Description of Artificial Sequence: Synthetic oligonucleotide
  Target: ATXN1; (+) strand; PAM type: YTN; PAM sequence: TTT
tagacattcagagtcaaggg

SEQ ID NO: 311944 - DNA, 20 bp, Artificial Sequence
  Description of Artificial Sequence: Synthetic oligonucleotide
  Target: ATXN1; (+) strand; PAM type: YTN; PAM sequence: TTT
agacattcagagtcaagggt

SEQ ID NO: 311945 - DNA, 20 bp, Artificial Sequence
  Description of Artificial Sequence: Synthetic oligonucleotide
  Target: ATXN1; (+) strand; PAM type: YTN; PAM sequence: TTA
gacattcagagtcaagggtt

SEQ ID NO: 311946 - DNA, 20 bp, Artificial Sequence
  Description of Artificial Sequence: Synthetic oligonucleotide
  Target: ATXN1; (+) strand; PAM type: YTN; PAM sequence: TTC
agagtcaagggttctacccc

SEQ ID NO: 311947 - DNA, 20 bp, Artificial Sequence
  Description of Artificial Sequence: Synthetic oligonucleotide
  Target: ATXN1; (+) strand; PAM type: YTN; PAM sequence: TTC
taccccagacataccaaatc

SEQ ID NO: 311948 - DNA, 20 bp, Artificial Sequence
  Description of Artificial Sequence: Synthetic oligonucleotide
  Target: ATXN1; (+) strand; PAM type: YTN; PAM sequence: CTA
ccccagacataccaaatcag

SEQ ID NO: 311949 - DNA, 20 bp, Artificial Sequence
  Description of Artificial Sequence: Synthetic oligonucleotide
  Target: ATXN1; (+) strand; PAM type: YTN; PAM sequence: CTG
cctttgaaccaggcccctgg

SEQ ID NO: 311950 - DNA, 20 bp, Artificial Sequence
  Description of Artificial Sequence: Synthetic oligonucleotide
  Target: ATXN1; (+) strand; PAM type: YTN; PAM sequence: CTT
tgaaccaggcccctgggtga

SEQ ID NO: 311951 - DNA, 20 bp, Artificial Sequence
  Description of Artificial Sequence: Synthetic oligonucleotide
  Target: ATXN1; (+) strand; PAM type: YTN; PAM sequence: TTT
gaaccaggcccctgggtgat

SEQ ID NO: 311952 - DNA, 20 bp, Artificial Sequence
  Description of Artificial Sequence: Synthetic oligonucleotide
  Target: ATXN1; (+) strand; PAM type: YTN; PAM sequence: TTG
aaccaggcccctgggtgatt

SEQ ID NO: 311953 - DNA, 20 bp, Artificial Sequence
  Description of Artificial Sequence: Synthetic oligonucleotide
  Target: ATXN1; (+) strand; PAM type: YTN; PAM sequence: CTG
ggtgatttctaaacacatta

SEQ ID NO: 311954 - DNA, 20 bp, Artificial Sequence
  Description of Artificial Sequence: Synthetic oligonucleotide
  Target: ATXN1; (+) strand; PAM type: YTN; PAM sequence: TTT
ctaaacacattatcatgtga

SEQ ID NO: 311955 - DNA, 20 bp, Artificial Sequence
  Description of Artificial Sequence: Synthetic oligonucleotide
  Target: ATXN1; (+) strand; PAM type: YTN; PAM sequence: TTC
taaacacattatcatgtgaa

SEQ ID NO: 311956 - DNA, 20 bp, Artificial Sequence
  Description of Artificial Sequence: Synthetic oligonucleotide
  Target: ATXN1; (+) strand; PAM type: YTN; PAM sequence: CTA
aacacattatcatgtgaaga

SEQ ID NO: 311957 - DNA, 20 bp, Artificial Sequence
  Description of Artificial Sequence: Synthetic oligonucleotide
  Target: ATXN1; (+) strand; PAM type: YTN; PAM sequence: TTA
tcatgtgaagaacactggtc

SEQ ID NO: 311958 - DNA, 20 bp, Artificial Sequence
  Description of Artificial Sequence: Synthetic oligonucleotide
  Target: ATXN1; (+) strand; PAM type: YTN; PAM sequence: CTG
gtctataccacagggatcaa

SEQ ID NO: 311959 - DNA, 20 bp, Artificial Sequence
  Description of Artificial Sequence: Synthetic oligonucleotide
  Target: ATXN1; (+) strand; PAM type: YTN; PAM sequence: CTA
taccacagggatcaacctaa

SEQ ID NO: 311960 - DNA, 20 bp, Artificial Sequence
  Description of Artificial Sequence: Synthetic oligonucleotide
  Target: ATXN1; (+) strand; PAM type: YTN; PAM sequence: CTA
aataaatttgggcacaagtg

SEQ ID NO: 311961 - DNA, 20 bp, Artificial Sequence
  Description of Artificial Sequence: Synthetic oligonucleotide
  Target: ATXN1; (+) strand; PAM type: YTN; PAM sequence: TTT
gggcacaagtgcagaagtta

SEQ ID NO: 311962 - DNA, 20 bp, Artificial Sequence
  Description of Artificial Sequence: Synthetic oligonucleotide
  Target: ATXN1; (+) strand; PAM type: YTN; PAM sequence: TTG
ggcacaagtgcagaagttaa

SEQ ID NO: 311963 - DNA, 20 bp, Artificial Sequence
  Description of Artificial Sequence: Synthetic oligonucleotide
  Target: ATXN1; (+) strand; PAM type: YTN; PAM sequence: TTA
attcctctatttatttcttt

SEQ ID NO: 311964 - DNA, 20 bp, Artificial Sequence
  Description of Artificial Sequence: Synthetic oligonucleotide
  Target: ATXN1; (+) strand; PAM type: YTN; PAM sequence: TTC
ctctatttatttcttttttg

SEQ ID NO: 311965 - DNA, 20 bp, Artificial Sequence
  Description of Artificial Sequence: Synthetic oligonucleotide
  Target: ATXN1; (+) strand; PAM type: YTN; PAM sequence: CTC
tatttatttcttttttgctc

SEQ ID NO: 311966 - DNA, 20 bp, Artificial Sequence
  Description of Artificial Sequence: Synthetic oligonucleotide
  Target: ATXN1; (+) strand; PAM type: YTN; PAM sequence: CTA
tttatttcttttttgctcct

SEQ ID NO: 311967 - DNA, 20 bp, Artificial Sequence
  Description of Artificial Sequence: Synthetic oligonucleotide
  Target: ATXN1; (+) strand; PAM type: YTN; PAM sequence: TTT
atttcttttttgctcctttt

SEQ ID NO: 311968 - DNA, 20 bp, Artificial Sequence
  Description of Artificial Sequence: Synthetic oligonucleotide
  Target: ATXN1; (+) strand; PAM type: YTN; PAM sequence: TTA
tttcttttttgctccttttt

SEQ ID NO: 311969 - DNA, 20 bp, Artificial Sequence
  Description of Artificial Sequence: Synthetic oligonucleotide
  Target: ATXN1; (+) strand; PAM type: YTN; PAM sequence: TTT
cttttttgctcctttttagt

SEQ ID NO: 311970 - DNA, 20 bp, Artificial Sequence
  Description of Artificial Sequence: Synthetic oligonucleotide
  Target: ATXN1; (+) strand; PAM type: YTN; PAM sequence: TTC
ttttttgctcctttttagta

SEQ ID NO: 311971 - DNA, 20 bp, Artificial Sequence
  Description of Artificial Sequence: Synthetic oligonucleotide
  Target: ATXN1; (+) strand; PAM type: YTN; PAM sequence: CTT
ttttgctcctttttagtaag

SEQ ID NO: 311972 - DNA, 20 bp, Artificial Sequence
  Description of Artificial Sequence: Synthetic oligonucleotide
  Target: ATXN1; (+) strand; PAM type: YTN; PAM sequence: TTT
tttgctcctttttagtaagt

SEQ ID NO: 311973 - DNA, 20 bp, Artificial Sequence
  Description of Artificial Sequence: Synthetic oligonucleotide
  Target: ATXN1; (+) strand; PAM type: YTN; PAM sequence: TTT
ttgctcctttttagtaagta

SEQ ID NO: 311974 - DNA, 20 bp, Artificial Sequence
  Description of Artificial Sequence: Synthetic oligonucleotide
  Target: ATXN1; (+) strand; PAM type: YTN; PAM sequence: TTT
tgctcctttttagtaagtac

SEQ ID NO: 311975 - DNA, 20 bp, Artificial Sequence
  Description of Artificial Sequence: Synthetic oligonucleotide
  Target: ATXN1; (+) strand; PAM type: YTN; PAM sequence: TTT
gctcctttttagtaagtaca

SEQ ID NO: 311976 - DNA, 20 bp, Artificial Sequence
  Description of Artificial Sequence: Synthetic oligonucleotide
  Target: ATXN1; (+) strand; PAM type: YTN; PAM sequence: TTG
ctcctttttagtaagtacag

SEQ ID NO: 311977 - DNA, 20 bp, Artificial Sequence
  Description of Artificial Sequence: Synthetic oligonucleotide
  Target: ATXN1; (+) strand; PAM type: YTN; PAM sequence: CTC
ctttttagtaagtacagccc

SEQ ID NO: 311978 - DNA, 20 bp, Artificial Sequence
  Description of Artificial Sequence: Synthetic oligonucleotide
  Target: ATXN1; (+) strand; PAM type: YTN; PAM sequence: CTT
tttagtaagtacagccctta

SEQ ID NO: 311979 - DNA, 20 bp, Artificial Sequence
  Description of Artificial Sequence: Synthetic oligonucleotide
  Target: ATXN1; (+) strand; PAM type: YTN; PAM sequence: TTT
ttagtaagtacagcccttat

SEQ ID NO: 311980 - DNA, 20 bp, Artificial Sequence
  Description of Artificial Sequence: Synthetic oligonucleotide
  Target: ATXN1; (+) strand; PAM type: YTN; PAM sequence: TTT
tagtaagtacagcccttatt

SEQ ID NO: 311981 - DNA, 20 bp, Artificial Sequence
  Description of Artificial Sequence: Synthetic oligonucleotide
  Target: ATXN1; (+) strand; PAM type: YTN; PAM sequence: TTT
agtaagtacagcccttatta

SEQ ID NO: 311982 - DNA, 20 bp, Artificial Sequence
  Description of Artificial Sequence: Synthetic oligonucleotide
  Target: ATXN1; (+) strand; PAM type: YTN; PAM sequence: TTA
gtaagtacagcccttattaa

SEQ ID NO: 311983 - DNA, 20 bp, Artificial Sequence
  Description of Artificial Sequence: Synthetic oligonucleotide
  Target: ATXN1; (+) strand; PAM type: YTN; PAM sequence: CTT
attaatttgtgcttttcaat

SEQ ID NO: 311984 - DNA, 20 bp, Artificial Sequence
  Description of Artificial Sequence: Synthetic oligonucleotide
  Target: ATXN1; (+) strand; PAM type: YTN; PAM sequence: TTA
ttaatttgtgcttttcaatg

SEQ ID NO: 311985 - DNA, 20 bp, Artificial Sequence
  Description of Artificial Sequence: Synthetic oligonucleotide
  Target: ATXN1; (+) strand; PAM type: YTN; PAM sequence: TTA
atttgtgcttttcaatgaaa

SEQ ID NO: 311986 - DNA, 20 bp, Artificial Sequence
  Description of Artificial Sequence: Synthetic oligonucleotide
  Target: ATXN1; (+) strand; PAM type: YTN; PAM sequence: TTT
gtgcttttcaatgaaaaatt

SEQ ID NO: 311987 - DNA, 20 bp, Artificial Sequence
  Description of Artificial Sequence: Synthetic oligonucleotide
  Target: ATXN1; (+) strand; PAM type: YTN; PAM sequence: TTG
tgcttttcaatgaaaaatta

SEQ ID NO: 311988 - DNA, 20 bp, Artificial Sequence
  Description of Artificial Sequence: Synthetic oligonucleotide
  Target: ATXN1; (+) strand; PAM type: YTN; PAM sequence: CTT
ttcaatgaaaaattattatg

SEQ ID NO: 311989 - DNA, 20 bp, Artificial Sequence
  Description of Artificial Sequence: Synthetic oligonucleotide
  Target: ATXN1; (+) strand; PAM type: YTN; PAM sequence: TTT
tcaatgaaaaattattatgt

SEQ ID NO: 311990 - DNA, 20 bp, Artificial Sequence
  Description of Artificial Sequence: Synthetic oligonucleotide
  Target: ATXN1; (+) strand; PAM type: YTN; PAM sequence: TTT
caatgaaaaattattatgtt

SEQ ID NO: 311991 - DNA, 20 bp, Artificial Sequence
  Description of Artificial Sequence: Synthetic oligonucleotide
  Target: ATXN1; (+) strand; PAM type: YTN; PAM sequence: TTC
aatgaaaaattattatgtta

SEQ ID NO: 311992 - DNA, 20 bp, Artificial Sequence
  Description of Artificial Sequence: Synthetic oligonucleotide
  Target: ATXN1; (+) strand; PAM type: YTN; PAM sequence: TTA
ttatgttatatgctttggat

SEQ ID NO: 311993 - DNA, 20 bp, Artificial Sequence
  Description of Artificial Sequence: Synthetic oligonucleotide
  Target: ATXN1; (+) strand; PAM type: YTN; PAM sequence: TTA
tgttatatgctttggataaa

SEQ ID NO: 311994 - DNA, 20 bp, Artificial Sequence
  Description of Artificial Sequence: Synthetic oligonucleotide
  Target: ATXN1; (+) strand; PAM type: YTN; PAM sequence: TTA
tatgctttggataaatacta

SEQ ID NO: 311995 - DNA, 20 bp, Artificial Sequence
  Description of Artificial Sequence: Synthetic oligonucleotide
  Target: ATXN1; (+) strand; PAM type: YTN; PAM sequence: CTT
tggataaatactactgcact

SEQ ID NO: 311996 - DNA, 20 bp, Artificial Sequence
  Description of Artificial Sequence: Synthetic oligonucleotide
  Target: ATXN1; (+) strand; PAM type: YTN; PAM sequence: TTT
ggataaatactactgcactg

SEQ ID NO: 311997 - DNA, 20 bp, Artificial Sequence
  Description of Artificial Sequence: Synthetic oligonucleotide
  Target: ATXN1; (+) strand; PAM type: YTN; PAM sequence: TTG
gataaatactactgcactgt

SEQ ID NO: 311998 - DNA, 20 bp, Artificial Sequence
  Description of Artificial Sequence: Synthetic oligonucleotide
  Target: ATXN1; (+) strand; PAM type: YTN; PAM sequence: CTA
ctgcactgtaagtgcacaca

SEQ ID NO: 311999 - DNA, 20 bp, Artificial Sequence
  Description of Artificial Sequence: Synthetic oligonucleotide
  Target: ATXN1; (+) strand; PAM type: YTN; PAM sequence: CTG
cactgtaagtgcacacatct

SEQ ID NO: 312000 - DNA, 20 bp, Artificial Sequence
  Description of Artificial Sequence: Synthetic oligonucleotide
  Target: ATXN1; (+) strand; PAM type: YTN; PAM sequence: CTG
taagtgcacacatctgcatc

SEQ ID NO: 312001 - DNA, 20 bp, Artificial Sequence
  Description of Artificial Sequence: Synthetic oligonucleotide
  Target: ATXN1; (+) strand; PAM type: YTN; PAM sequence: CTG
catcattattgccaaaaaag

SEQ ID NO: 312002 - DNA, 20 bp, Artificial Sequence
  Description of Artificial Sequence: Synthetic oligonucleotide
  Target: ATXN1; (+) strand; PAM type: YTN; PAM sequence: TTA
ttgccaaaaaagaatgctct

SEQ ID NO: 312003 - DNA, 20 bp, Artificial Sequence
  Description of Artificial Sequence: Synthetic oligonucleotide
  Target: ATXN1; (+) strand; PAM type: YTN; PAM sequence: TTG
ccaaaaaagaatgctctgct

SEQ ID NO: 312004 - DNA, 20 bp, Artificial Sequence
  Description of Artificial Sequence: Synthetic oligonucleotide
  Target: ATXN1; (+) strand; PAM type: YTN; PAM sequence: CTC
tgctgaggaatgtactgggg

SEQ ID NO: 312005 - DNA, 20 bp, Artificial Sequence
  Description of Artificial Sequence: Synthetic oligonucleotide
  Target: ATXN1; (+) strand; PAM type: YTN; PAM sequence: CTG
ctgaggaatgtactggggtc

SEQ ID NO: 312006 - DNA, 20 bp, Artificial Sequence
  Description of Artificial Sequence: Synthetic oligonucleotide
  Target: ATXN1; (+) strand; PAM type: YTN; PAM sequence: CTG
aggaatgtactggggtcttg

SEQ ID NO: 312007 - DNA, 20 bp, Artificial Sequence
  Description of Artificial Sequence: Synthetic oligonucleotide
  Target: ATXN1; (+) strand; PAM type: YTN; PAM sequence: CTG
gggtcttgaacatgaacatt

SEQ ID NO: 312008 - DNA, 20 bp, Artificial Sequence
  Description of Artificial Sequence: Synthetic oligonucleotide
  Target: ATXN1; (+) strand; PAM type: YTN; PAM sequence: CTT
gaacatgaacattttcttca

SEQ ID NO: 312009 - DNA, 20 bp, Artificial Sequence
  Description of Artificial Sequence: Synthetic oligonucleotide
  Target: ATXN1; (+) strand; PAM type: YTN; PAM sequence: TTG
aacatgaacattttcttcat

SEQ ID NO: 312010 - DNA, 20 bp, Artificial Sequence
  Description of Artificial Sequence: Synthetic oligonucleotide
  Target: ATXN1; (+) strand; PAM type: YTN; PAM sequence: TTT
tcttcatggcagcagaggga

SEQ ID NO: 312011 - DNA, 20 bp, Artificial Sequence
  Description of Artificial Sequence: Synthetic oligonucleotide
  Target: ATXN1; (+) strand; PAM type: YTN; PAM sequence: TTT
cttcatggcagcagagggag

SEQ ID NO: 312012 - DNA, 20 bp, Artificial Sequence
  Description of Artificial Sequence: Synthetic oligonucleotide
  Target: ATXN1; (+) strand; PAM type: YTN; PAM sequence: TTC
ttcatggcagcagagggagc

SEQ ID NO: 312013 - DNA, 20 bp, Artificial Sequence
  Description of Artificial Sequence: Synthetic oligonucleotide
  Target: ATXN1; (+) strand; PAM type: YTN; PAM sequence: CTT
catggcagcagagggagcac

SEQ ID NO: 312014 - DNA, 20 bp, Artificial Sequence
  Description of Artificial Sequence: Synthetic oligonucleotide
  Target: ATXN1; (+) strand; PAM type: YTN; PAM sequence: TTC
atggcagcagagggagcaca

SEQ ID NO: 312015 - DNA, 20 bp, Artificial Sequence
  Description of Artificial Sequence: Synthetic oligonucleotide
  Target: ATXN1; (+) strand; PAM type: YTN; PAM sequence: CTT
aataaaaccagtgcacaggt

SEQ ID NO: 312016 - DNA, 20 bp, Artificial Sequence
  Description of Artificial Sequence: Synthetic oligonucleotide
  Target: ATXN1; (+) strand; PAM type: YTN; PAM sequence: TTA
ataaaaccagtgcacaggtc

SEQ ID NO: 312017 - DNA, 20 bp, Artificial Sequence
  Description of Artificial Sequence: Synthetic oligonucleotide
  Target: ATXN1; (+) strand; PAM type: YTN; PAM sequence: CTC
tccaaatcatgacagatttt

SEQ ID NO: 312018 - DNA, 20 bp, Artificial Sequence
  Description of Artificial Sequence: Synthetic oligonucleotide
  Target: ATXN1; (+) strand; PAM type: YTN; PAM sequence: CTC
caaatcatgacagattttac

SEQ ID NO: 312019 - DNA, 20 bp, Artificial Sequence
  Description of Artificial Sequence: Synthetic oligonucleotide
  Target: ATXN1; (+) strand; PAM type: YTN; PAM sequence: TTT
tacattgtagtatatgtttt

SEQ ID NO: 312020 - DNA, 20 bp, Artificial Sequence
  Description of Artificial Sequence: Synthetic oligonucleotide
  Target: ATXN1; (+) strand; PAM type: YTN; PAM sequence: TTT
acattgtagtatatgttttc

SEQ ID NO: 312021 - DNA, 20 bp, Artificial Sequence
  Description of Artificial Sequence: Synthetic oligonucleotide
  Target: ATXN1; (+) strand; PAM type: YTN; PAM sequence: TTA
cattgtagtatatgttttca

SEQ ID NO: 312022 - DNA, 20 bp, Artificial Sequence
  Description of Artificial Sequence: Synthetic oligonucleotide
  Target: ATXN1; (+) strand; PAM type: YTN; PAM sequence: TTG
tagtatatgttttcattgga

SEQ ID NO: 312023 - DNA, 20 bp, Artificial Sequence
  Description of Artificial Sequence: Synthetic oligonucleotide
  Target: ATXN1; (+) strand; PAM type: YTN; PAM sequence: TTT
tcattggaagtagcctgtta

SEQ ID NO: 312024 - DNA, 20 bp, Artificial Sequence
  Description of Artificial Sequence: Synthetic oligonucleotide
  Target: ATXN1; (+) strand; PAM type: YTN; PAM sequence: TTT
cattggaagtagcctgttat

SEQ ID NO: 312025 - DNA, 20 bp, Artificial Sequence
  Description of Artificial Sequence: Synthetic oligonucleotide
  Target: ATXN1; (+) strand; PAM type: YTN; PAM sequence: TTC
attggaagtagcctgttatg

SEQ ID NO: 312026 - DNA, 20 bp, Artificial Sequence
  Description of Artificial Sequence: Synthetic oligonucleotide
  Target: ATXN1; (+) strand; PAM type: YTN; PAM sequence: TTG
gaagtagcctgttatgtagt

SEQ ID NO: 312027 - DNA, 20 bp, Artificial Sequence
  Description of Artificial Sequence: Synthetic oligonucleotide
  Target: ATXN1; (+) strand; PAM type: YTN; PAM sequence: CTG
ttatgtagttcaaaatgaag

SEQ ID NO: 312028 - DNA, 20 bp, Artificial Sequence
  Description of Artificial Sequence: Synthetic oligonucleotide
  Target: ATXN1; (+) strand; PAM type: YTN; PAM sequence: TTA
tgtagttcaaaatgaagcaa

SEQ ID NO: 312029 - DNA, 20 bp, Artificial Sequence
  Description of Artificial Sequence: Synthetic oligonucleotide
  Target: ATXN1; (+) strand; PAM type: YTN; PAM sequence: TTC
aaaatgaagcaaatcaactg

SEQ ID NO: 312030 - DNA, 20 bp, Artificial Sequence
  Description of Artificial Sequence: Synthetic oligonucleotide
  Target: ATXN1; (+) strand; PAM type: YTN; PAM sequence: CTG
agcaaacacagataggctta

SEQ ID NO: 312031 - DNA, 20 bp, Artificial Sequence
  Description of Artificial Sequence: Synthetic oligonucleotide
  Target: ATXN1; (+) strand; PAM type: YTN; PAM sequence: CTT
accaggtcataacaactatg

SEQ ID NO: 312032 - DNA, 20 bp, Artificial Sequence
  Description of Artificial Sequence: Synthetic oligonucleotide
  Target: ATXN1; (+) strand; PAM type: YTN; PAM sequence: TTA
ccaggtcataacaactatgt

SEQ ID NO: 312033 - DNA, 20 bp, Artificial Sequence
  Description of Artificial Sequence: Synthetic oligonucleotide
  Target: ATXN1; (+) strand; PAM type: YTN; PAM sequence: CTA
tgtaactgaacagattgaaa

SEQ ID NO: 312034 - DNA, 20 bp, Artificial Sequence
  Description of Artificial Sequence: Synthetic oligonucleotide
  Target: ATXN1; (+) strand; PAM type: YTN; PAM sequence: CTG
aacagattgaaagttgaata

SEQ ID NO: 312035 - DNA, 20 bp, Artificial Sequence
  Description of Artificial Sequence: Synthetic oligonucleotide
  Target: ATXN1; (+) strand; PAM type: YTN; PAM sequence: TTG
aaagttgaataaaataaaga

SEQ ID NO: 312036 - DNA, 20 bp, Artificial Sequence
  Description of Artificial Sequence: Synthetic oligonucleotide
  Target: ATXN1; (+) strand; PAM type: YTN; PAM sequence: TTG
aataaaataaagataaactt

SEQ ID NO: 312037 - DNA, 20 bp, Artificial Sequence
  Description of Artificial Sequence: Synthetic oligonucleotide
  Target: ATXN1; (+) strand; PAM type: YTN; PAM sequence: CTT
ctttagagttttaggcttga

SEQ ID NO: 312038 - DNA, 20 bp, Artificial Sequence
  Description of Artificial Sequence: Synthetic oligonucleotide
  Target: ATXN1; (+) strand; PAM type: YTN; PAM sequence: TTC
tttagagttttaggcttgaa

SEQ ID NO: 312039 - DNA, 20 bp, Artificial Sequence
  Description of Artificial Sequence: Synthetic oligonucleotide
  Target: ATXN1; (+) strand; PAM type: YTN; PAM sequence: CTT
tagagttttaggcttgaatt

SEQ ID NO: 312040 - DNA, 20 bp, Artificial Sequence
  Description of Artificial Sequence: Synthetic oligonucleotide
  Target: ATXN1; (+) strand; PAM type: YTN; PAM sequence: TTT
agagttttaggcttgaattc

SEQ ID NO: 312041 - DNA, 20 bp, Artificial Sequence
  Description of Artificial Sequence: Synthetic oligonucleotide
  Target: ATXN1; (+) strand; PAM type: YTN; PAM sequence: TTA
gagttttaggcttgaattct

SEQ ID NO: 312042 - DNA, 20 bp, Artificial Sequence
  Description of Artificial Sequence: Synthetic oligonucleotide
  Target: ATXN1; (+) strand; PAM type: YTN; PAM sequence: TTT
taggcttgaattcttaaaag

SEQ ID NO: 312043 - DNA, 20 bp, Artificial Sequence
  Description of Artificial Sequence: Synthetic oligonucleotide
  Target: ATXN1; (+) strand; PAM type: YTN; PAM sequence: TTT
aggcttgaattcttaaaaga

SEQ ID NO: 312044 - DNA, 20 bp, Artificial Sequence
  Description of Artificial Sequence: Synthetic oligonucleotide
  Target: ATXN1; (+) strand; PAM type: YTN; PAM sequence: TTA
ggcttgaattcttaaaagaa

SEQ ID NO: 312045 - DNA, 20 bp, Artificial Sequence
  Description of Artificial Sequence: Synthetic oligonucleotide
  Target: ATXN1; (+) strand; PAM type: YTN; PAM sequence: CTT
gaattcttaaaagaaagtgg

SEQ ID NO: 312046 - DNA, 20 bp, Artificial Sequence
  Description of Artificial Sequence: Synthetic oligonucleotide
  Target: ATXN1; (+) strand; PAM type: YTN; PAM sequence: TTG
aattcttaaaagaaagtgga

SEQ ID NO: 312047 - DNA, 20 bp, Artificial Sequence
  Description of Artificial Sequence: Synthetic oligonucleotide
  Target: ATXN1; (+) strand; PAM type: YTN; PAM sequence: TTC
ttaaaagaaagtggacctca

SEQ ID NO: 312048 - DNA, 20 bp, Artificial Sequence
  Description of Artificial Sequence: Synthetic oligonucleotide
  Target: ATXN1; (+) strand; PAM type: YTN; PAM sequence: CTT
aaaagaaagtggacctcaaa

SEQ ID NO: 312049 - DNA, 20 bp, Artificial Sequence
  Description of Artificial Sequence: Synthetic oligonucleotide
  Target: ATXN1; (+) strand; PAM type: YTN; PAM sequence: TTA
aaagaaagtggacctcaaaa

SEQ ID NO: 312050 - DNA, 20 bp, Artificial Sequence
  Description of Artificial Sequence: Synthetic oligonucleotide
  Target: ATXN1; (+) strand; PAM type: YTN; PAM sequence: CTC
aaaagtgaaaaagatgcctt

SEQ ID NO: 312051 - DNA, 20 bp, Artificial Sequence
  Description of Artificial Sequence: Synthetic oligonucleotide
  Target: ATXN1; (+) strand; PAM type: YTN; PAM sequence: CTT
agctttgctcaaaaacaaag

SEQ ID NO: 312052 - DNA, 20 bp, Artificial Sequence
  Description of Artificial Sequence: Synthetic oligonucleotide
  Target: ATXN1; (+) strand; PAM type: YTN; PAM sequence: TTA
gctttgctcaaaaacaaaga

SEQ ID NO: 312053 - DNA, 20 bp, Artificial Sequence
  Description of Artificial Sequence: Synthetic oligonucleotide
  Target: ATXN1; (+) strand; PAM type: YTN; PAM sequence: CTT
tgctcaaaaacaaagataac

SEQ ID NO: 312054 - DNA, 20 bp, Artificial Sequence
  Description of Artificial Sequence: Synthetic oligonucleotide
  Target: ATXN1; (+) strand; PAM type: YTN; PAM sequence: TTT
gctcaaaaacaaagataaca

SEQ ID NO: 312055 - DNA, 20 bp, Artificial Sequence
  Description of Artificial Sequence: Synthetic oligonucleotide
  Target: ATXN1; (+) strand; PAM type: YTN; PAM sequence: TTG
ctcaaaaacaaagataacac

SEQ ID NO: 312056 - DNA, 20 bp, Artificial Sequence
  Description of Artificial Sequence: Synthetic oligonucleotide
  Target: ATXN1; (+) strand; PAM type: YTN; PAM sequence: CTC
aaaaacaaagataacacaac

SEQ ID NO: 312057 - DNA, 20 bp, Artificial Sequence
  Description of Artificial Sequence: Synthetic oligonucleotide
  Target: ATXN1; (+) strand; PAM type: YTN; PAM sequence: CTA
agatgccttagctttactca

SEQ ID NO: 312058 - DNA, 20 bp, Artificial Sequence
  Description of Artificial Sequence: Synthetic oligonucleotide
  Target: ATXN1; (+) strand; PAM type: YTN; PAM sequence: CTT
agctttactcaaaaacaaag

SEQ ID NO: 312059 - DNA, 20 bp, Artificial Sequence
  Description of Artificial Sequence: Synthetic oligonucleotide
  Target: ATXN1; (+) strand; PAM type: YTN; PAM sequence: TTA
gctttactcaaaaacaaaga

SEQ ID NO: 312060 - DNA, 20 bp, Artificial Sequence
  Description of Artificial Sequence: Synthetic oligonucleotide
  Target: ATXN1; (+) strand; PAM type: YTN; PAM sequence: CTT
tactcaaaaacaaagataac

SEQ ID NO: 312061 - DNA, 20 bp, Artificial Sequence
  Description of Artificial Sequence: Synthetic oligonucleotide
  Target: ATXN1; (+) strand; PAM type: YTN; PAM sequence: TTT
actcaaaaacaaagataaca

SEQ ID NO: 312062 - DNA, 20 bp, Artificial Sequence
  Description of Artificial Sequence: Synthetic oligonucleotide
  Target: ATXN1; (+) strand; PAM type: YTN; PAM sequence: TTA
ctcaaaaacaaagataacac

SEQ ID NO: 312063 - DNA, 20 bp, Artificial Sequence
  Description of Artificial Sequence: Synthetic oligonucleotide
  Target: ATXN1; (+) strand; PAM type: YTN; PAM sequence: CTC
aaaaacaaagataacacaga

SEQ ID NO: 312064 - DNA, 20 bp, Artificial Sequence
  Description of Artificial Sequence: Synthetic oligonucleotide
  Target: ATXN1; (+) strand; PAM type: YTN; PAM sequence: CTA
atagtagctcctgtttatct

SEQ ID NO: 312065 - DNA, 20 bp, Artificial Sequence
  Description of Artificial Sequence: Synthetic oligonucleotide
  Target: ATXN1; (+) strand; PAM type: YTN; PAM sequence: CTC
ctgtttatctaaaaacagag

SEQ ID NO: 312066 - DNA, 20 bp, Artificial Sequence
  Description of Artificial Sequence: Synthetic oligonucleotide
  Target: ATXN1; (+) strand; PAM type: YTN; PAM sequence: CTG
tttatctaaaaacagagtca

SEQ ID NO: 312067 - DNA, 20 bp, Artificial Sequence
  Description of Artificial Sequence: Synthetic oligonucleotide
  Target: ATXN1; (+) strand; PAM type: YTN; PAM sequence: TTT
atctaaaaacagagtcagtt

SEQ ID NO: 312068 - DNA, 20 bp, Artificial Sequence
  Description of Artificial Sequence: Synthetic oligonucleotide
  Target: ATXN1; (+) strand; PAM type: YTN; PAM sequence: TTA
tctaaaaacagagtcagttc

SEQ ID NO: 312069 - DNA, 20 bp, Artificial Sequence
  Description of Artificial Sequence: Synthetic oligonucleotide
  Target: ATXN1; (+) strand; PAM type: YTN; PAM sequence: CTA
aaaacagagtcagttcactg

SEQ ID NO: 312070 - DNA, 20 bp, Artificial Sequence
  Description of Artificial Sequence: Synthetic oligonucleotide
  Target: ATXN1; (+) strand; PAM type: YTN; PAM sequence: TTC
actggaccctacatcaggta

SEQ ID NO: 312071 - DNA, 20 bp, Artificial Sequence
  Description of Artificial Sequence: Synthetic oligonucleotide
  Target: ATXN1; (+) strand; PAM type: YTN; PAM sequence: CTG
gaccctacatcaggtaactt

SEQ ID NO: 312072 - DNA, 20 bp, Artificial Sequence
  Description of Artificial Sequence: Synthetic oligonucleotide
  Target: ATXN1; (+) strand; PAM type: YTN; PAM sequence: CTA
catcaggtaacttaatttca

SEQ ID NO: 312073 - DNA, 20 bp, Artificial Sequence
  Description of Artificial Sequence: Synthetic oligonucleotide
  Target: ATXN1; (+) strand; PAM type: YTN; PAM sequence: CTT
aatttcatttggtgtcatac

SEQ ID NO: 312074 - DNA, 20 bp, Artificial Sequence
  Description of Artificial Sequence: Synthetic oligonucleotide
  Target: ATXN1; (+) strand; PAM type: YTN; PAM sequence: TTA
atttcatttggtgtcataca

SEQ ID NO: 312075 - DNA, 20 bp, Artificial Sequence
  Description of Artificial Sequence: Synthetic oligonucleotide
  Target: ATXN1; (+) strand; PAM type: YTN; PAM sequence: TTT
catttggtgtcatacatgtt

SEQ ID NO: 312076 - DNA, 20 bp, Artificial Sequence
  Description of Artificial Sequence: Synthetic oligonucleotide
  Target: ATXN1; (+) strand; PAM type: YTN; PAM sequence: TTC
atttggtgtcatacatgttg

SEQ ID NO: 312077 - DNA, 20 bp, Artificial Sequence
  Description of Artificial Sequence: Synthetic oligonucleotide
  Target: ATXN1; (+) strand; PAM type: YTN; PAM sequence: TTT
ggtgtcatacatgttggtta

SEQ ID NO: 312078 - DNA, 20 bp, Artificial Sequence
  Description of Artificial Sequence: Synthetic oligonucleotide
  Target: ATXN1; (+) strand; PAM type: YTN; PAM sequence: TTG
gtgtcatacatgttggttaa

SEQ ID NO: 312079 - DNA, 20 bp, Artificial Sequence
  Description of Artificial Sequence: Synthetic oligonucleotide
  Target: ATXN1; (+) strand; PAM type: YTN; PAM sequence: TTG
gttaaggtccatgcgccttt

SEQ ID NO: 312080 - DNA, 20 bp, Artificial Sequence
  Description of Artificial Sequence: Synthetic oligonucleotide
  Target: ATXN1; (+) strand; PAM type: YTN; PAM sequence: TTA
aggtccatgcgccttttgct

SEQ ID NO: 312081 - DNA, 20 bp, Artificial Sequence
  Description of Artificial Sequence: Synthetic oligonucleotide
  Target: ATXN1; (+) strand; PAM type: YTN; PAM sequence: CTT
ttgctgtgtttacactcaga

SEQ ID NO: 312082 - DNA, 20 bp, Artificial Sequence
  Description of Artificial Sequence: Synthetic oligonucleotide
  Target: ATXN1; (+) strand; PAM type: YTN; PAM sequence: TTT
tgctgtgtttacactcagaa

SEQ ID NO: 312083 - DNA, 20 bp, Artificial Sequence
  Description of Artificial Sequence: Synthetic oligonucleotide
  Target: ATXN1; (+) strand; PAM type: YTN; PAM sequence: TTT
gctgtgtttacactcagaat

SEQ ID NO: 312084 - DNA, 20 bp, Artificial Sequence
  Description of Artificial Sequence: Synthetic oligonucleotide
  Target: ATXN1; (+) strand; PAM type: YTN; PAM sequence: TTG
ctgtgtttacactcagaata

SEQ ID NO: 312085 - DNA, 20 bp, Artificial Sequence
  Description of Artificial Sequence: Synthetic oligonucleotide
  Target: ATXN1; (+) strand; PAM type: YTN; PAM sequence: CTG
tgtttacactcagaataatt

SEQ ID NO: 312086 - DNA, 20 bp, Artificial Sequence
  Description of Artificial Sequence: Synthetic oligonucleotide
  Target: ATXN1; (+) strand; PAM type: YTN; PAM sequence: TTT
acactcagaataattttagg

SEQ ID NO: 312087 - DNA, 20 bp, Artificial Sequence
  Description of Artificial Sequence: Synthetic oligonucleotide
  Target: ATXN1; (+) strand; PAM type: YTN; PAM sequence: TTA
cactcagaataattttaggg

SEQ ID NO: 312088 - DNA, 20 bp, Artificial Sequence
  Description of Artificial Sequence: Synthetic oligonucleotide
  Target: ATXN1; (+) strand; PAM type: YTN; PAM sequence: CTC
agaataattttaggggtttc

SEQ ID NO: 312089 - DNA, 20 bp, Artificial Sequence
  Description of Artificial Sequence: Synthetic oligonucleotide
  Target: ATXN1; (+) strand; PAM type: YTN; PAM sequence: TTT
taggggtttctccttaatgc

SEQ ID NO: 312090 - DNA, 20 bp, Artificial Sequence
  Description of Artificial Sequence: Synthetic oligonucleotide
  Target: ATXN1; (+) strand; PAM type: YTN; PAM sequence: TTT
aggggtttctccttaatgct

SEQ ID NO: 312091 - DNA, 20 bp, Artificial Sequence
  Description of Artificial Sequence: Synthetic oligonucleotide
  Target: ATXN1; (+) strand; PAM type: YTN; PAM sequence: TTA
ggggtttctccttaatgctt

SEQ ID NO: 312092 - DNA, 20 bp, Artificial Sequence
  Description of Artificial Sequence: Synthetic oligonucleotide
  Target: ATXN1; (+) strand; PAM type: YTN; PAM sequence: TTT
ctccttaatgcttgcagtgg

SEQ ID NO: 312093 - DNA, 20 bp, Artificial Sequence
  Description of Artificial Sequence: Synthetic oligonucleotide
  Target: ATXN1; (+) strand; PAM type: YTN; PAM sequence: TTC
tccttaatgcttgcagtggt

SEQ ID NO: 312094 - DNA, 20 bp, Artificial Sequence
  Description of Artificial Sequence: Synthetic oligonucleotide
  Target: ATXN1; (+) strand; PAM type: YTN; PAM sequence: CTC
cttaatgcttgcagtggtga

SEQ ID NO: 312095 - DNA, 20 bp, Artificial Sequence
  Description of Artificial Sequence: Synthetic oligonucleotide
  Target: ATXN1; (+) strand; PAM type: YTN; PAM sequence: CTT
aatgcttgcagtggtgagga

SEQ ID NO: 312096 - DNA, 20 bp, Artificial Sequence
  Description of Artificial Sequence: Synthetic oligonucleotide
  Target: ATXN1; (+) strand; PAM type: YTN; PAM sequence: TTA
atgcttgcagtggtgaggat

SEQ ID NO: 312097 - DNA, 20 bp, Artificial Sequence
  Description of Artificial Sequence: Synthetic oligonucleotide
  Target: ATXN1; (+) strand; PAM type: YTN; PAM sequence: CTT
gcagtggtgaggatttaggt

SEQ ID NO: 312098 - DNA, 20 bp, Artificial Sequence
  Description of Artificial Sequence: Synthetic oligonucleotide
  Target: ATXN1; (+) strand; PAM type: YTN; PAM sequence: TTG
cagtggtgaggatttaggtt

SEQ ID NO: 312099 - DNA, 20 bp, Artificial Sequence
  Description of Artificial Sequence: Synthetic oligonucleotide
  Target: ATXN1; (+) strand; PAM type: YTN; PAM sequence: TTT
aggtttcagttatacctacg

SEQ ID NO: 312100 - DNA, 20 bp, Artificial Sequence
  Description of Artificial Sequence: Synthetic oligonucleotide
  Target: ATXN1; (+) strand; PAM type: YTN; PAM sequence: TTA
ggtttcagttatacctacgt

SEQ ID NO: 312101 - DNA, 20 bp, Artificial Sequence
  Description of Artificial Sequence: Synthetic oligonucleotide
  Target: ATXN1; (+) strand; PAM type: YTN; PAM sequence: TTT
cagttatacctacgtagtat

SEQ ID NO: 312102 - DNA, 20 bp, Artificial Sequence
  Description of Artificial Sequence: Synthetic oligonucleotide
  Target: ATXN1; (+) strand; PAM type: YTN; PAM sequence: TTC
agttatacctacgtagtatt

SEQ ID NO: 312103 - DNA, 20 bp, Artificial Sequence
  Description of Artificial Sequence: Synthetic oligonucleotide
  Target: ATXN1; (+) strand; PAM type: YTN; PAM sequence: TTA
tacctacgtagtatttcata

SEQ ID NO: 312104 - DNA, 20 bp, Artificial Sequence
  Description of Artificial Sequence: Synthetic oligonucleotide
  Target: ATXN1; (+) strand; PAM type: YTN; PAM sequence: CTA
cgtagtatttcatacttttc

SEQ ID NO: 312105 - DNA, 20 bp, Artificial Sequence
  Description of Artificial Sequence: Synthetic oligonucleotide
  Target: ATXN1; (+) strand; PAM type: YTN; PAM sequence: TTT
catacttttcactactcttc

SEQ ID NO: 312106 - DNA, 20 bp, Artificial Sequence
  Description of Artificial Sequence: Synthetic oligonucleotide
  Target: ATXN1; (+) strand; PAM type: YTN; PAM sequence: TTC
atacttttcactactcttcc

SEQ ID NO: 312107 - DNA, 20 bp, Artificial Sequence
  Description of Artificial Sequence: Synthetic oligonucleotide
  Target: ATXN1; (+) strand; PAM type: YTN; PAM sequence: CTT
ttcactactcttccatattg

SEQ ID NO: 312108 - DNA, 20 bp, Artificial Sequence
  Description of Artificial Sequence: Synthetic oligonucleotide
  Target: ATXN1; (+) strand; PAM type: YTN; PAM sequence: TTT
tcactactcttccatattgc

SEQ ID NO: 312109 - DNA, 20 bp, Artificial Sequence
  Description of Artificial Sequence: Synthetic oligonucleotide
  Target: ATXN1; (+) strand; PAM type: YTN; PAM sequence: TTT
cactactcttccatattgca

SEQ ID NO: 312110 - DNA, 20 bp, Artificial Sequence
  Description of Artificial Sequence: Synthetic oligonucleotide
  Target: ATXN1; (+) strand; PAM type: YTN; PAM sequence: TTC
actactcttccatattgcat

SEQ ID NO: 312111 - DNA, 20 bp, Artificial Sequence
  Description of Artificial Sequence: Synthetic oligonucleotide
  Target: ATXN1; (+) strand; PAM type: YTN; PAM sequence: CTA
ctcttccatattgcatcctc

SEQ ID NO: 312112 - DNA, 20 bp, Artificial Sequence
  Description of Artificial Sequence: Synthetic oligonucleotide
  Target: ATXN1; (+) strand; PAM type: YTN; PAM sequence: CTC
ttccatattgcatcctcaaa

SEQ ID NO: 312113 - DNA, 20 bp, Artificial Sequence
  Description of Artificial Sequence: Synthetic oligonucleotide
  Target: ATXN1; (+) strand; PAM type: YTN; PAM sequence: CTT
ccatattgcatcctcaaaaa

SEQ ID NO: 312114 - DNA, 20 bp, Artificial Sequence
  Description of Artificial Sequence: Synthetic oligonucleotide
  Target: ATXN1; (+) strand; PAM type: YTN; PAM sequence: TTC
catattgcatcctcaaaaac

SEQ ID NO: 312115 - DNA, 20 bp, Artificial Sequence
  Description of Artificial Sequence: Synthetic oligonucleotide
  Target: ATXN1; (+) strand; PAM type: YTN; PAM sequence: TTG
catcctcaaaaactcccttg

SEQ ID NO: 312116 - DNA, 20 bp, Artificial Sequence
  Description of Artificial Sequence: Synthetic oligonucleotide
  Target: ATXN1; (+) strand; PAM type: YTN; PAM sequence: CTC
aaaaactcccttgaagcaga

SEQ ID NO: 312117 - DNA, 20 bp, Artificial Sequence
  Description of Artificial Sequence: Synthetic oligonucleotide
  Target: ATXN1; (+) strand; PAM type: YTN; PAM sequence: CTC
ccttgaagcagataacatac

SEQ ID NO: 312118 - DNA, 20 bp, Artificial Sequence
  Description of Artificial Sequence: Synthetic oligonucleotide
  Target: ATXN1; (+) strand; PAM type: YTN; PAM sequence: CTT
gaagcagataacatacttgg

SEQ ID NO: 312119 - DNA, 20 bp, Artificial Sequence
  Description of Artificial Sequence: Synthetic oligonucleotide
  Target: ATXN1; (+) strand; PAM type: YTN; PAM sequence: TTG
aagcagataacatacttggt

SEQ ID NO: 312120 - DNA, 20 bp, Artificial Sequence
  Description of Artificial Sequence: Synthetic oligonucleotide
  Target: ATXN1; (+) strand; PAM type: YTN; PAM sequence: CTT
ggtaaaagccaagtatccaa

SEQ ID NO: 312121 - DNA, 20 bp, Artificial Sequence
  Description of Artificial Sequence: Synthetic oligonucleotide
  Target: ATXN1; (+) strand; PAM type: YTN; PAM sequence: TTG
gtaaaagccaagtatccaaa

SEQ ID NO: 312122 - DNA, 20 bp, Artificial Sequence
  Description of Artificial Sequence: Synthetic oligonucleotide
  Target: ATXN1; (+) strand; PAM type: YTN; PAM sequence: TTA
tggaaccacatcgtgctttc

SEQ ID NO: 312123 - DNA, 20 bp, Artificial Sequence
  Description of Artificial Sequence: Synthetic oligonucleotide
  Target: ATXN1; (+) strand; PAM type: YTN; PAM sequence: CTT
tcataacattgagtcattta

SEQ ID NO: 312124 - DNA, 20 bp, Artificial Sequence
  Description of Artificial Sequence: Synthetic oligonucleotide
  Target: ATXN1; (+) strand; PAM type: YTN; PAM sequence: TTT
cataacattgagtcatttaa

SEQ ID NO: 312125 - DNA, 20 bp, Artificial Sequence
  Description of Artificial Sequence: Synthetic oligonucleotide
  Target: ATXN1; (+) strand; PAM type: YTN; PAM sequence: TTC
ataacattgagtcatttaat

SEQ ID NO: 312126 - DNA, 20 bp, Artificial Sequence
  Description of Artificial Sequence: Synthetic oligonucleotide
  Target: ATXN1; (+) strand; PAM type: YTN; PAM sequence: TTG
agtcatttaattgtttcagt

SEQ ID NO: 312127 - DNA, 20 bp, Artificial Sequence
  Description of Artificial Sequence: Synthetic oligonucleotide
  Target: ATXN1; (+) strand; PAM type: YTN; PAM sequence: TTT
aattgtttcagtagtgcttt

SEQ ID NO: 312128 - DNA, 20 bp, Artificial Sequence
  Description of Artificial Sequence: Synthetic oligonucleotide
  Target: ATXN1; (+) strand; PAM type: YTN; PAM sequence: TTA
attgtttcagtagtgctttg

SEQ ID NO: 312129 - DNA, 20 bp, Artificial Sequence
  Description of Artificial Sequence: Synthetic oligonucleotide
  Target: ATXN1; (+) strand; PAM type: YTN; PAM sequence: TTG
tttcagtagtgctttgaggt

SEQ ID NO: 312130 - DNA, 20 bp, Artificial Sequence
  Description of Artificial Sequence: Synthetic oligonucleotide
  Target: ATXN1; (+) strand; PAM type: YTN; PAM sequence: TTT
cagtagtgctttgaggtatt

SEQ ID NO: 312131 - DNA, 20 bp, Artificial Sequence
  Description of Artificial Sequence: Synthetic oligonucleotide
  Target: ATXN1; (+) strand; PAM type: YTN; PAM sequence: TTC
agtagtgctttgaggtattc

SEQ ID NO: 312132 - DNA, 20 bp, Artificial Sequence
  Description of Artificial Sequence: Synthetic oligonucleotide
  Target: ATXN1; (+) strand; PAM type: YTN; PAM sequence: CTT
tgaggtattcataaatgagg

SEQ ID NO: 312133 - DNA, 20 bp, Artificial Sequence
  Description of Artificial Sequence: Synthetic oligonucleotide
  Target: ATXN1; (+) strand; PAM type: YTN; PAM sequence: TTT
gaggtattcataaatgaggg

SEQ ID NO: 312134 - DNA, 20 bp, Artificial Sequence
  Description of Artificial Sequence: Synthetic oligonucleotide
  Target: ATXN1; (+) strand; PAM type: YTN; PAM sequence: TTG
aggtattcataaatgaggga

SEQ ID NO: 312135 - DNA, 20 bp, Artificial Sequence
  Description of Artificial Sequence: Synthetic oligonucleotide
  Target: ATXN1; (+) strand; PAM type: YTN; PAM sequence: TTC
ataaatgagggaaattatac

SEQ ID NO: 312136 - DNA, 20 bp, Artificial Sequence
  Description of Artificial Sequence: Synthetic oligonucleotide
  Target: ATXN1; (+) strand; PAM type: YTN; PAM sequence: TTA
tacagactaaagatccagag

SEQ ID NO: 312137 - DNA, 20 bp, Artificial Sequence
  Description of Artificial Sequence: Synthetic oligonucleotide
  Target: ATXN1; (+) strand; PAM type: YTN; PAM sequence: CTA
aagatccagagcatttttta

SEQ ID NO: 312138 - DNA, 20 bp, Artificial Sequence
  Description of Artificial Sequence: Synthetic oligonucleotide
  Target: ATXN1; (+) strand; PAM type: YTN; PAM sequence: TTT
tttacagttttaaaggtttt

SEQ ID NO: 312139 - DNA, 20 bp, Artificial Sequence
  Description of Artificial Sequence: Synthetic oligonucleotide
  Target: ATXN1; (+) strand; PAM type: YTN; PAM sequence: TTT
ttacagttttaaaggttttt

SEQ ID NO: 312140 - DNA, 20 bp, Artificial Sequence
  Description of Artificial Sequence: Synthetic oligonucleotide
  Target: ATXN1; (+) strand; PAM type: YTN; PAM sequence: TTT
tacagttttaaaggtttttc

SEQ ID NO: 312141 - DNA, 20 bp, Artificial Sequence
  Description of Artificial Sequence: Synthetic oligonucleotide
  Target: ATXN1; (+) strand; PAM type: YTN; PAM sequence: TTT
acagttttaaaggtttttca

SEQ ID NO: 312142 - DNA, 20 bp, Artificial Sequence
  Description of Artificial Sequence: Synthetic oligonucleotide
  Target: ATXN1; (+) strand; PAM type: YTN; PAM sequence: TTA
cagttttaaaggtttttcaa

SEQ ID NO: 312143 - DNA, 20 bp, Artificial Sequence
  Description of Artificial Sequence: Synthetic oligonucleotide
  Target: ATXN1; (+) strand; PAM type: YTN; PAM sequence: TTT
taaaggtttttcaaagttat

SEQ ID NO: 312144 - DNA, 20 bp, Artificial Sequence
  Description of Artificial Sequence: Synthetic oligonucleotide
  Target: ATXN1; (+) strand; PAM type: YTN; PAM sequence: TTT
aaaggtttttcaaagttatt

SEQ ID NO: 312145 - DNA, 20 bp, Artificial Sequence
  Description of Artificial Sequence: Synthetic oligonucleotide
  Target: ATXN1; (+) strand; PAM type: YTN; PAM sequence: TTA
aaggtttttcaaagttattc

SEQ ID NO: 312146 - DNA, 20 bp, Artificial Sequence
  Description of Artificial Sequence: Synthetic oligonucleotide
  Target: ATXN1; (+) strand; PAM type: YTN; PAM sequence: TTT
ttcaaagttattcttagata

SEQ ID NO: 312147 - DNA, 20 bp, Artificial Sequence
  Description of Artificial Sequence: Synthetic oligonucleotide
  Target: ATXN1; (+) strand; PAM type: YTN; PAM sequence: TTT
tcaaagttattcttagataa

SEQ ID NO: 312148 - DNA, 20 bp, Artificial Sequence
  Description of Artificial Sequence: Synthetic oligonucleotide
  Target: ATXN1; (+) strand; PAM type: YTN; PAM sequence: TTT
caaagttattcttagataat

SEQ ID NO: 312149 - DNA, 20 bp, Artificial Sequence
  Description of Artificial Sequence: Synthetic oligonucleotide
  Target: ATXN1; (+) strand; PAM type: YTN; PAM sequence: TTC
aaagttattcttagataata

SEQ ID NO: 312150 - DNA, 20 bp, Artificial Sequence
  Description of Artificial Sequence: Synthetic oligonucleotide
  Target: ATXN1; (+) strand; PAM type: YTN; PAM sequence: TTA
ttcttagataatatgtttat

SEQ ID NO: 312151 - DNA, 20 bp, Artificial Sequence
  Description of Artificial Sequence: Synthetic oligonucleotide
  Target: ATXN1; (+) strand; PAM type: YTN; PAM sequence: TTC
ttagataatatgtttatata

SEQ ID NO: 312152 - DNA, 20 bp, Artificial Sequence
  Description of Artificial Sequence: Synthetic oligonucleotide
  Target: ATXN1; (+) strand; PAM type: YTN; PAM sequence: CTT
agataatatgtttatatatt

SEQ ID NO: 312153 - DNA, 20 bp, Artificial Sequence
  Description of Artificial Sequence: Synthetic oligonucleotide
  Target: ATXN1; (+) strand; PAM type: YTN; PAM sequence: TTA
gataatatgtttatatattt

SEQ ID NO: 312154 - DNA, 20 bp, Artificial Sequence
  Description of Artificial Sequence: Synthetic oligonucleotide
  Target: ATXN1; (+) strand; PAM type: YTN; PAM sequence: TTT
atatatttattatttattta

SEQ ID NO: 312155 - DNA, 20 bp, Artificial Sequence
  Description of Artificial Sequence: Synthetic oligonucleotide
  Target: ATXN1; (+) strand; PAM type: YTN; PAM sequence: TTA
tatatttattatttatttac

SEQ ID NO: 312156 - DNA, 20 bp, Artificial Sequence
  Description of Artificial Sequence: Synthetic oligonucleotide
  Target: ATXN1; (+) strand; PAM type: YTN; PAM sequence: TTT
attatttatttacaagcagt

SEQ ID NO: 312157 - DNA, 20 bp, Artificial Sequence
  Description of Artificial Sequence: Synthetic oligonucleotide
  Target: ATXN1; (+) strand; PAM type: YTN; PAM sequence: TTA
ttatttatttacaagcagtc

SEQ ID NO: 312158 - DNA, 20 bp, Artificial Sequence
  Description of Artificial Sequence: Synthetic oligonucleotide
  Target: ATXN1; (+) strand; PAM type: YTN; PAM sequence: TTA
tttatttacaagcagtcact

SEQ ID NO: 312159 - DNA, 20 bp, Artificial Sequence
  Description of Artificial Sequence: Synthetic oligonucleotide
  Target: ATXN1; (+) strand; PAM type: YTN; PAM sequence: TTT
atttacaagcagtcacttac

SEQ ID NO: 312160 - DNA, 20 bp, Artificial Sequence
  Description of Artificial Sequence: Synthetic oligonucleotide
  Target: ATXN1; (+) strand; PAM type: YTN; PAM sequence: TTA
tttacaagcagtcacttact

SEQ ID NO: 312161 - DNA, 20 bp, Artificial Sequence
  Description of Artificial Sequence: Synthetic oligonucleotide
  Target: ATXN1; (+) strand; PAM type: YTN; PAM sequence: TTT
acaagcagtcacttactctg

SEQ ID NO: 312162 - DNA, 20 bp, Artificial Sequence
  Description of Artificial Sequence: Synthetic oligonucleotide
  Target: ATXN1; (+) strand; PAM type: YTN; PAM sequence: TTA
caagcagtcacttactctgc

SEQ ID NO: 312163 - DNA, 20 bp, Artificial Sequence
  Description of Artificial Sequence: Synthetic oligonucleotide
  Target: ATXN1; (+) strand; PAM type: YTN; PAM sequence: CTT
actctgcatctacaataact

SEQ ID NO: 312164 - DNA, 20 bp, Artificial Sequence
  Description of Artificial Sequence: Synthetic oligonucleotide
  Target: ATXN1; (+) strand; PAM type: YTN; PAM sequence: TTA
ctctgcatctacaataacta

SEQ ID NO: 312165 - DNA, 20 bp, Artificial Sequence
  Description of Artificial Sequence: Synthetic oligonucleotide
  Target: ATXN1; (+) strand; PAM type: YTN; PAM sequence: CTC
tgcatctacaataactaaga

SEQ ID NO: 312166 - DNA, 20 bp, Artificial Sequence
  Description of Artificial Sequence: Synthetic oligonucleotide
  Target: ATXN1; (+) strand; PAM type: YTN; PAM sequence: CTG
catctacaataactaagact

SEQ ID NO: 312167 - DNA, 20 bp, Artificial Sequence
  Description of Artificial Sequence: Synthetic oligonucleotide
  Target: ATXN1; (+) strand; PAM type: YTN; PAM sequence: CTA
caataactaagacttgagaa

SEQ ID NO: 312168 - DNA, 20 bp, Artificial Sequence
  Description of Artificial Sequence: Synthetic oligonucleotide
  Target: ATXN1; (+) strand; PAM type: YTN; PAM sequence: CTA
agacttgagaatataaaatt

SEQ ID NO: 312169 - DNA, 20 bp, Artificial Sequence
  Description of Artificial Sequence: Synthetic oligonucleotide
  Target: ATXN1; (+) strand; PAM type: YTN; PAM sequence: CTT
gagaatataaaattgagtaa

SEQ ID NO: 312170 - DNA, 20 bp, Artificial Sequence
  Description of Artificial Sequence: Synthetic oligonucleotide
  Target: ATXN1; (+) strand; PAM type: YTN; PAM sequence: TTG
agaatataaaattgagtaag

SEQ ID NO: 312171 - DNA, 20 bp, Artificial Sequence
  Description of Artificial Sequence: Synthetic oligonucleotide
  Target: ATXN1; (+) strand; PAM type: YTN; PAM sequence: TTG
agtaagacatcttagtgtgc

SEQ ID NO: 312172 - DNA, 20 bp, Artificial Sequence
  Description of Artificial Sequence: Synthetic oligonucleotide
  Target: ATXN1; (+) strand; PAM type: YTN; PAM sequence: CTT
agtgtgcaaggagatcagag

SEQ ID NO: 312173 - DNA, 20 bp, Artificial Sequence
  Description of Artificial Sequence: Synthetic oligonucleotide
  Target: ATXN1; (+) strand; PAM type: YTN; PAM sequence: TTA
gtgtgcaaggagatcagagc

SEQ ID NO: 312174 - DNA, 20 bp, Artificial Sequence
  Description of Artificial Sequence: Synthetic oligonucleotide
  Target: ATXN1; (+) strand; PAM type: YTN; PAM sequence: CTT
acctttggaaaactgttaat

SEQ ID NO: 312175 - DNA, 20 bp, Artificial Sequence
  Description of Artificial Sequence: Synthetic oligonucleotide
  Target: ATXN1; (+) strand; PAM type: YTN; PAM sequence: TTA
cctttggaaaactgttaatt

SEQ ID NO: 312176 - DNA, 20 bp, Artificial Sequence
  Description of Artificial Sequence: Synthetic oligonucleotide
  Target: ATXN1; (+) strand; PAM type: YTN; PAM sequence: CTT
tggaaaactgttaattttta

SEQ ID NO: 312177 - DNA, 20 bp, Artificial Sequence
  Description of Artificial Sequence: Synthetic oligonucleotide
  Target: ATXN1; (+) strand; PAM type: YTN; PAM sequence: TTT
ggaaaactgttaatttttac

SEQ ID NO: 312178 - DNA, 20 bp, Artificial Sequence
  Description of Artificial Sequence: Synthetic oligonucleotide
  Target: ATXN1; (+) strand; PAM type: YTN; PAM sequence: TTG
gaaaactgttaatttttacc

SEQ ID NO: 312179 - DNA, 20 bp, Artificial Sequence
  Description of Artificial Sequence: Synthetic oligonucleotide
  Target: ATXN1; (+) strand; PAM type: YTN; PAM sequence: CTG
ttaatttttaccacgttgaa

SEQ ID NO: 312180 - DNA, 20 bp, Artificial Sequence
  Description of Artificial Sequence: Synthetic oligonucleotide
  Target: ATXN1; (+) strand; PAM type: YTN; PAM sequence: TTA
atttttaccacgttgaaaca

SEQ ID NO: 312181 - DNA, 20 bp, Artificial Sequence
  Description of Artificial Sequence: Synthetic oligonucleotide
  Target: ATXN1; (+) strand; PAM type: YTN; PAM sequence: TTT
ttaccacgttgaaacacaaa

SEQ ID NO: 312182 - DNA, 20 bp, Artificial Sequence
  Description of Artificial Sequence: Synthetic oligonucleotide
  Target: ATXN1; (+) strand; PAM type: YTN; PAM sequence: TTT
taccacgttgaaacacaaag

SEQ ID NO: 312183 - DNA, 20 bp, Artificial Sequence
  Description of Artificial Sequence: Synthetic oligonucleotide
  Target: ATXN1; (+) strand; PAM type: YTN; PAM sequence: TTT
accacgttgaaacacaaaga

SEQ ID NO: 312184 - DNA, 20 bp, Artificial Sequence
  Description of Artificial Sequence: Synthetic oligonucleotide
  Target: ATXN1; (+) strand; PAM type: YTN; PAM sequence: TTA
ccacgttgaaacacaaagat

SEQ ID NO: 312185 - DNA, 20 bp, Artificial Sequence
  Description of Artificial Sequence: Synthetic oligonucleotide
  Target: ATXN1; (+) strand; PAM type: YTN; PAM sequence: TTG
aaacacaaagattcatagtt

SEQ ID NO: 312186 - DNA, 20 bp, Artificial Sequence
  Description of Artificial Sequence: Synthetic oligonucleotide
  Target: ATXN1; (+) strand; PAM type: YTN; PAM sequence: TTC
atagttgatgcgatccagca

SEQ ID NO: 312187 - DNA, 20 bp, Artificial Sequence
  Description of Artificial Sequence: Synthetic oligonucleotide
  Target: ATXN1; (+) strand; PAM type: YTN; PAM sequence: TTG
atgcgatccagcacctgcca

SEQ ID NO: 312188 - DNA, 20 bp, Artificial Sequence
  Description of Artificial Sequence: Synthetic oligonucleotide
  Target: ATXN1; (+) strand; PAM type: YTN; PAM sequence: CTG
ccagaatcatagcaatcaga

SEQ ID NO: 312189 - DNA, 20 bp, Artificial Sequence
  Description of Artificial Sequence: Synthetic oligonucleotide
  Target: ATXN1; (+) strand; PAM type: YTN; PAM sequence: CTT
ccaaatatgagaatcaaaca

SEQ ID NO: 312190 - DNA, 20 bp, Artificial Sequence
  Description of Artificial Sequence: Synthetic oligonucleotide
  Target: ATXN1; (+) strand; PAM type: YTN; PAM sequence: TTC
caaatatgagaatcaaacat

SEQ ID NO: 312191 - DNA, 20 bp, Artificial Sequence
  Description of Artificial Sequence: Synthetic oligonucleotide
  Target: ATXN1; (+) strand; PAM type: YTN; PAM sequence: TTA
gaatcattaaaaatttgaga

SEQ ID NO: 312192 - DNA, 20 bp, Artificial Sequence
  Description of Artificial Sequence: Synthetic oligonucleotide
  Target: ATXN1; (+) strand; PAM type: YTN; PAM sequence: TTA
aaaatttgagaggcgggggg

SEQ ID NO: 312193 - DNA, 20 bp, Artificial Sequence
  Description of Artificial Sequence: Synthetic oligonucleotide
  Target: ATXN1; (+) strand; PAM type: YTN; PAM sequence: TTT
gagaggcgggggggacagtt

SEQ ID NO: 312194 - DNA, 20 bp, Artificial Sequence
  Description of Artificial Sequence: Synthetic oligonucleotide
  Target: ATXN1; (+) strand; PAM type: YTN; PAM sequence: TTG
agaggcgggggggacagttg

SEQ ID NO: 312195 - DNA, 20 bp, Artificial Sequence
  Description of Artificial Sequence: Synthetic oligonucleotide
  Target: ATXN1; (+) strand; PAM type: YTN; PAM sequence: TTG
tacaactcttgagcaaaagt

SEQ ID NO: 312196 - DNA, 20 bp, Artificial Sequence
  Description of Artificial Sequence: Synthetic oligonucleotide
  Target: ATXN1; (+) strand; PAM type: YTN; PAM sequence: CTC
ttgagcaaaagttgacttat

SEQ ID NO: 312197 - DNA, 20 bp, Artificial Sequence
  Description of Artificial Sequence: Synthetic oligonucleotide
  Target: ATXN1; (+) strand; PAM type: YTN; PAM sequence: CTT
gagcaaaagttgacttataa

SEQ ID NO: 312198 - DNA, 20 bp, Artificial Sequence
  Description of Artificial Sequence: Synthetic oligonucleotide
  Target: ATXN1; (+) strand; PAM type: YTN; PAM sequence: TTG
agcaaaagttgacttataag

SEQ ID NO: 312199 - DNA, 20 bp, Artificial Sequence
  Description of Artificial Sequence: Synthetic oligonucleotide
  Target: ATXN1; (+) strand; PAM type: YTN; PAM sequence: TTG
acttataagctaatattaat

SEQ ID NO: 312200 - DNA, 20 bp, Artificial Sequence
  Description of Artificial Sequence: Synthetic oligonucleotide
  Target: ATXN1; (+) strand; PAM type: YTN; PAM sequence: CTT
ataagctaatattaatattt

SEQ ID NO: 312201 - DNA, 20 bp, Artificial Sequence
  Description of Artificial Sequence: Synthetic oligonucleotide
  Target: ATXN1; (+) strand; PAM type: YTN; PAM sequence: TTA
taagctaatattaatatttc

SEQ ID NO: 312202 - DNA, 20 bp, Artificial Sequence
  Description of Artificial Sequence: Synthetic oligonucleotide
  Target: ATXN1; (+) strand; PAM type: YTN; PAM sequence: CTA
atattaatatttcaaatttg

SEQ ID NO: 312203 - DNA, 20 bp, Artificial Sequence
  Description of Artificial Sequence: Synthetic oligonucleotide
  Target: ATXN1; (+) strand; PAM type: YTN; PAM sequence: TTA
atatttcaaatttgtacgac

SEQ ID NO: 312204 - DNA, 20 bp, Artificial Sequence
  Description of Artificial Sequence: Synthetic oligonucleotide
  Target: ATXN1; (+) strand; PAM type: YTN; PAM sequence: TTT
caaatttgtacgacaaacaa

SEQ ID NO: 312205 - DNA, 20 bp, Artificial Sequence
  Description of Artificial Sequence: Synthetic oligonucleotide
  Target: ATXN1; (+) strand; PAM type: YTN; PAM sequence: TTC
aaatttgtacgacaaacaaa

SEQ ID NO: 312206 - DNA, 20 bp, Artificial Sequence
  Description of Artificial Sequence: Synthetic oligonucleotide
  Target: ATXN1; (+) strand; PAM type: YTN; PAM sequence: TTT
gtacgacaaacaaatgtgaa

SEQ ID NO: 312207 - DNA, 20 bp, Artificial Sequence
  Description of Artificial Sequence: Synthetic oligonucleotide
  Target: ATXN1; (+) strand; PAM type: YTN; PAM sequence: TTG
tacgacaaacaaatgtgaag

SEQ ID NO: 312208 - DNA, 20 bp, Artificial Sequence
  Description of Artificial Sequence: Synthetic oligonucleotide
  Target: ATXN1; (+) strand; PAM type: YTN; PAM sequence: TTT
tatttgaatgtcttccctat

SEQ ID NO: 312209 - DNA, 20 bp, Artificial Sequence
  Description of Artificial Sequence: Synthetic oligonucleotide
  Target: ATXN1; (+) strand; PAM type: YTN; PAM sequence: TTT
atttgaatgtcttccctatc

SEQ ID NO: 312210 - DNA, 20 bp, Artificial Sequence
  Description of Artificial Sequence: Synthetic oligonucleotide
  Target: ATXN1; (+) strand; PAM type: YTN; PAM sequence: TTA
tttgaatgtcttccctatca

SEQ ID NO: 312211 - DNA, 20 bp, Artificial Sequence
  Description of Artificial Sequence: Synthetic oligonucleotide
  Target: ATXN1; (+) strand; PAM type: YTN; PAM sequence: TTT
gaatgtcttccctatcacaa

SEQ ID NO: 312212 - DNA, 20 bp, Artificial Sequence
  Description of Artificial Sequence: Synthetic oligonucleotide
  Target: ATXN1; (+) strand; PAM type: YTN; PAM sequence: TTG
aatgtcttccctatcacaaa

SEQ ID NO: 312213 - DNA, 20 bp, Artificial Sequence
  Description of Artificial Sequence: Synthetic oligonucleotide
  Target: ATXN1; (+) strand; PAM type: YTN; PAM sequence: CTT
ccctatcacaaaatcacatg

SEQ ID NO: 312214 - DNA, 20 bp, Artificial Sequence
  Description of Artificial Sequence: Synthetic oligonucleotide
  Target: ATXN1; (+) strand; PAM type: YTN; PAM sequence: TTC
cctatcacaaaatcacatga

SEQ ID NO: 312215 - DNA, 20 bp, Artificial Sequence
  Description of Artificial Sequence: Synthetic oligonucleotide
  Target: ATXN1; (+) strand; PAM type: YTN; PAM sequence: CTA
tcacaaaatcacatgagtaa

SEQ ID NO: 312216 - DNA, 20 bp, Artificial Sequence
  Description of Artificial Sequence: Synthetic oligonucleotide
  Target: ATXN1; (+) strand; PAM type: YTN; PAM sequence: TTG
agttggtaaacatttattta

SEQ ID NO: 312217 - DNA, 20 bp, Artificial Sequence
  Description of Artificial Sequence: Synthetic oligonucleotide
  Target: ATXN1; (+) strand; PAM type: YTN; PAM sequence: TTG
gtaaacatttatttattttt

SEQ ID NO: 312218 - DNA, 20 bp, Artificial Sequence
  Description of Artificial Sequence: Synthetic oligonucleotide
  Target: ATXN1; (+) strand; PAM type: YTN; PAM sequence: TTT
atttatttttatcttttcta

SEQ ID NO: 312219 - DNA, 20 bp, Artificial Sequence
  Description of Artificial Sequence: Synthetic oligonucleotide
  Target: ATXN1; (+) strand; PAM type: YTN; PAM sequence: TTA
tttatttttatcttttctaa

SEQ ID NO: 312220 - DNA, 20 bp, Artificial Sequence
  Description of Artificial Sequence: Synthetic oligonucleotide
  Target: ATXN1; (+) strand; PAM type: YTN; PAM sequence: TTT
atttttatcttttctaaaat

SEQ ID NO: 312221 - DNA, 20 bp, Artificial Sequence
  Description of Artificial Sequence: Synthetic oligonucleotide
  Target: ATXN1; (+) strand; PAM type: YTN; PAM sequence: TTA
tttttatcttttctaaaatg

SEQ ID NO: 312222 - DNA, 20 bp, Artificial Sequence
  Description of Artificial Sequence: Synthetic oligonucleotide
  Target: ATXN1; (+) strand; PAM type: YTN; PAM sequence: TTT
ttatcttttctaaaatgctg

SEQ ID NO: 312223 - DNA, 20 bp, Artificial Sequence
  Description of Artificial Sequence: Synthetic oligonucleotide
  Target: ATXN1; (+) strand; PAM type: YTN; PAM sequence: TTT
tatcttttctaaaatgctga

SEQ ID NO: 312224 - DNA, 20 bp, Artificial Sequence
  Description of Artificial Sequence: Synthetic oligonucleotide
  Target: ATXN1; (+) strand; PAM type: YTN; PAM sequence: TTT
atcttttctaaaatgctgaa

SEQ ID NO: 312225 - DNA, 20 bp, Artificial Sequence
  Description of Artificial Sequence: Synthetic oligonucleotide
  Target: ATXN1; (+) strand; PAM type: YTN; PAM sequence: TTA
tcttttctaaaatgctgaaa

SEQ ID NO: 312226 - DNA, 20 bp, Artificial Sequence
  Description of Artificial Sequence: Synthetic oligonucleotide
  Target: ATXN1; (+) strand; PAM type: YTN; PAM sequence: CTT
ttctaaaatgctgaaaagaa

SEQ ID NO: 312227 - DNA, 20 bp, Artificial Sequence
  Description of Artificial Sequence: Synthetic oligonucleotide
  Target: ATXN1; (+) strand; PAM type: YTN; PAM sequence: TTT
tctaaaatgctgaaaagaat

SEQ ID NO: 312228 - DNA, 20 bp, Artificial Sequence
  Description of Artificial Sequence: Synthetic oligonucleotide
  Target: ATXN1; (+) strand; PAM type: YTN; PAM sequence: TTT
ctaaaatgctgaaaagaatt

SEQ ID NO: 312229 - DNA, 20 bp, Artificial Sequence
  Description of Artificial Sequence: Synthetic oligonucleotide
  Target: ATXN1; (+) strand; PAM type: YTN; PAM sequence: TTC
taaaatgctgaaaagaattt

SEQ ID NO: 312230 - DNA, 20 bp, Artificial Sequence
  Description of Artificial Sequence: Synthetic oligonucleotide
  Target: ATXN1; (+) strand; PAM type: YTN; PAM sequence: CTA
aaatgctgaaaagaattttt

SEQ ID NO: 312231 - DNA, 20 bp, Artificial Sequence
  Description of Artificial Sequence: Synthetic oligonucleotide
  Target: ATXN1; (+) strand; PAM type: YTN; PAM sequence: CTG
aaaagaatttttctcccaca

SEQ ID NO: 312232 - DNA, 20 bp, Artificial Sequence
  Description of Artificial Sequence: Synthetic oligonucleotide
  Target: ATXN1; (+) strand; PAM type: YTN; PAM sequence: TTT
ttctcccacactaaagaggg

SEQ ID NO: 312233 - DNA, 20 bp, Artificial Sequence
  Description of Artificial Sequence: Synthetic oligonucleotide
  Target: ATXN1; (+) strand; PAM type: YTN; PAM sequence: TTT
tctcccacactaaagagggt

SEQ ID NO: 312234 - DNA, 20 bp, Artificial Sequence
  Description of Artificial Sequence: Synthetic oligonucleotide
  Target: ATXN1; (+) strand; PAM type: YTN; PAM sequence: TTT
ctcccacactaaagagggtt

SEQ ID NO: 312235 - DNA, 20 bp, Artificial Sequence
  Description of Artificial Sequence: Synthetic oligonucleotide
  Target: ATXN1; (+) strand; PAM type: YTN; PAM sequence: TTC
tcccacactaaagagggttt

SEQ ID NO: 312236 - DNA, 20 bp, Artificial Sequence
  Description of Artificial Sequence: Synthetic oligonucleotide
  Target: ATXN1; (+) strand; PAM type: YTN; PAM sequence: CTC
ccacactaaagagggtttgc

SEQ ID NO: 312237 - DNA, 20 bp, Artificial Sequence
  Description of Artificial Sequence: Synthetic oligonucleotide
  Target: ATXN1; (+) strand; PAM type: YTN; PAM sequence: CTA
aagagggtttgccaagtttc

SEQ ID NO: 312238 - DNA, 20 bp, Artificial Sequence
  Description of Artificial Sequence: Synthetic oligonucleotide
  Target: ATXN1; (+) strand; PAM type: YTN; PAM sequence: TTT
gccaagtttctgcctggagc

SEQ ID NO: 312239 - DNA, 20 bp, Artificial Sequence
  Description of Artificial Sequence: Synthetic oligonucleotide
  Target: ATXN1; (+) strand; PAM type: YTN; PAM sequence: TTG
ccaagtttctgcctggagca

SEQ ID NO: 312240 - DNA, 20 bp, Artificial Sequence
  Description of Artificial Sequence: Synthetic oligonucleotide
  Target: ATXN1; (+) strand; PAM type: YTN; PAM sequence: TTT
ctgcctggagcaatttgtta

SEQ ID NO: 312241 - DNA, 20 bp, Artificial Sequence
  Description of Artificial Sequence: Synthetic oligonucleotide
  Target: ATXN1; (+) strand; PAM type: YTN; PAM sequence: TTC
tgcctggagcaatttgttat

SEQ ID NO: 312242 - DNA, 20 bp, Artificial Sequence
  Description of Artificial Sequence: Synthetic oligonucleotide
  Target: ATXN1; (+) strand; PAM type: YTN; PAM sequence: CTG
cctggagcaatttgttatgg

SEQ ID NO: 312243 - DNA, 20 bp, Artificial Sequence
  Description of Artificial Sequence: Synthetic oligonucleotide
  Target: ATXN1; (+) strand; PAM type: YTN; PAM sequence: CTG
gagcaatttgttatggctgt

SEQ ID NO: 312244 - DNA, 20 bp, Artificial Sequence
  Description of Artificial Sequence: Synthetic oligonucleotide
  Target: ATXN1; (+) strand; PAM type: YTN; PAM sequence: TTT
gttatggctgtgtaataaat

SEQ ID NO: 312245 - DNA, 20 bp, Artificial Sequence
  Description of Artificial Sequence: Synthetic oligonucleotide
  Target: ATXN1; (+) strand; PAM type: YTN; PAM sequence: TTG
ttatggctgtgtaataaatc

SEQ ID NO: 312246 - DNA, 20 bp, Artificial Sequence
  Description of Artificial Sequence: Synthetic oligonucleotide
  Target: ATXN1; (+) strand; PAM type: YTN; PAM sequence: TTA
tggctgtgtaataaatccca

SEQ ID NO: 312247 - DNA, 20 bp, Artificial Sequence
  Description of Artificial Sequence: Synthetic oligonucleotide
  Target: ATXN1; (+) strand; PAM type: YTN; PAM sequence: CTG
tgtaataaatcccagaaagt

SEQ ID NO: 312248 - DNA, 20 bp, Artificial Sequence
  Description of Artificial Sequence: Synthetic oligonucleotide
  Target: ATXN1; (+) strand; PAM type: YTN; PAM sequence: TTT
gaatttttaatggaaacact

SEQ ID NO: 312249 - DNA, 20 bp, Artificial Sequence
  Description of Artificial Sequence: Synthetic oligonucleotide
  Target: ATXN1; (+) strand; PAM type: YTN; PAM sequence: TTG
aatttttaatggaaacactg

SEQ ID NO: 312250 - DNA, 20 bp, Artificial Sequence
  Description of Artificial Sequence: Synthetic oligonucleotide
  Target: ATXN1; (+) strand; PAM type: YTN; PAM sequence: TTT
ttaatggaaacactgacaga

SEQ ID NO: 312251 - DNA, 20 bp, Artificial Sequence
  Description of Artificial Sequence: Synthetic oligonucleotide
  Target: ATXN1; (+) strand; PAM type: YTN; PAM sequence: TTT
taatggaaacactgacagaa

SEQ ID NO: 312252 - DNA, 20 bp, Artificial Sequence
  Description of Artificial Sequence: Synthetic oligonucleotide
  Target: ATXN1; (+) strand; PAM type: YTN; PAM sequence: TTT
aatggaaacactgacagaat

SEQ ID NO: 312253 - DNA, 20 bp, Artificial Sequence
  Description of Artificial Sequence: Synthetic oligonucleotide
  Target: ATXN1; (+) strand; PAM type: YTN; PAM sequence: TTA
atggaaacactgacagaata

SEQ ID NO: 312254 - DNA, 20 bp, Artificial Sequence
  Description of Artificial Sequence: Synthetic oligonucleotide
  Target: ATXN1; (+) strand; PAM type: YTN; PAM sequence: CTG
acagaataaagagggtgtaa

SEQ ID NO: 312255 - DNA, 20 bp, Artificial Sequence
  Description of Artificial Sequence: Synthetic oligonucleotide
  Target: ATXN1; (+) strand; PAM type: YTN; PAM sequence: CTA
catatgtcatttaaaaatct

SEQ ID NO: 312256 - DNA, 20 bp, Artificial Sequence
  Description of Artificial Sequence: Synthetic oligonucleotide
  Target: ATXN1; (+) strand; PAM type: YTN; PAM sequence: TTT
aaaaatctgagcaaaccata

SEQ ID NO: 312257 - DNA, 20 bp, Artificial Sequence
  Description of Artificial Sequence: Synthetic oligonucleotide
  Target: ATXN1; (+) strand; PAM type: YTN; PAM sequence: TTA
aaaatctgagcaaaccatag

SEQ ID NO: 312258 - DNA, 20 bp, Artificial Sequence
  Description of Artificial Sequence: Synthetic oligonucleotide
  Target: ATXN1; (+) strand; PAM type: YTN; PAM sequence: CTG
agcaaaccatagtgtgcttg

SEQ ID NO: 312259 - DNA, 20 bp, Artificial Sequence
  Description of Artificial Sequence: Synthetic oligonucleotide
  Target: ATXN1; (+) strand; PAM type: YTN; PAM sequence: CTT
gcaaaacaaatatactttcc

SEQ ID NO: 312260 - DNA, 20 bp, Artificial Sequence
  Description of Artificial Sequence: Synthetic oligonucleotide
  Target: ATXN1; (+) strand; PAM type: YTN; PAM sequence: TTG
caaaacaaatatactttcct

SEQ ID NO: 312261 - DNA, 20 bp, Artificial Sequence
  Description of Artificial Sequence: Synthetic oligonucleotide
  Target: ATXN1; (+) strand; PAM type: YTN; PAM sequence: CTT
tccttagattgcactcacaa

SEQ ID NO: 312262 - DNA, 20 bp, Artificial Sequence
  Description of Artificial Sequence: Synthetic oligonucleotide
  Target: ATXN1; (+) strand; PAM type: YTN; PAM sequence: TTT
ccttagattgcactcacaaa

SEQ ID NO: 312263 - DNA, 20 bp, Artificial Sequence
  Description of Artificial Sequence: Synthetic oligonucleotide
  Target: ATXN1; (+) strand; PAM type: YTN; PAM sequence: TTC
cttagattgcactcacaaat

SEQ ID NO: 312264 - DNA, 20 bp, Artificial Sequence
  Description of Artificial Sequence: Synthetic oligonucleotide
  Target: ATXN1; (+) strand; PAM type: YTN; PAM sequence: CTT
agattgcactcacaaataag

SEQ ID NO: 312265 - DNA, 20 bp, Artificial Sequence
  Description of Artificial Sequence: Synthetic oligonucleotide
  Target: ATXN1; (+) strand; PAM type: YTN; PAM sequence: TTA
gattgcactcacaaataagg

SEQ ID NO: 312266 - DNA, 20 bp, Artificial Sequence
  Description of Artificial Sequence: Synthetic oligonucleotide
  Target: ATXN1; (+) strand; PAM type: YTN; PAM sequence: TTG
cactcacaaataaggctggg

SEQ ID NO: 312267 - DNA, 20 bp, Artificial Sequence
  Description of Artificial Sequence: Synthetic oligonucleotide
  Target: ATXN1; (+) strand; PAM type: YTN; PAM sequence: CTC
acaaataaggctggggagac

SEQ ID NO: 312268 - DNA, 20 bp, Artificial Sequence
  Description of Artificial Sequence: Synthetic oligonucleotide
  Target: ATXN1; (+) strand; PAM type: YTN; PAM sequence: CTG
gggagaccacaaaagtaaaa

SEQ ID NO: 312269 - DNA, 20 bp, Artificial Sequence
  Description of Artificial Sequence: Synthetic oligonucleotide
  Target: ATXN1; (+) strand; PAM type: YTN; PAM sequence: CTC
aaaagtgaaaaacactcaca

SEQ ID NO: 312270 - DNA, 20 bp, Artificial Sequence
  Description of Artificial Sequence: Synthetic oligonucleotide
  Target: ATXN1; (+) strand; PAM type: YTN; PAM sequence: CTC
acacaatagactctgaggtc

SEQ ID NO: 312271 - DNA, 20 bp, Artificial Sequence
  Description of Artificial Sequence: Synthetic oligonucleotide
  Target: ATXN1; (+) strand; PAM type: YTN; PAM sequence: CTC
tgaggtcagctcaccacacc

SEQ ID NO: 312272 - DNA, 20 bp, Artificial Sequence
  Description of Artificial Sequence: Synthetic oligonucleotide
  Target: ATXN1; (+) strand; PAM type: YTN; PAM sequence: CTG
aggtcagctcaccacaccca

SEQ ID NO: 312273 - DNA, 20 bp, Artificial Sequence
  Description of Artificial Sequence: Synthetic oligonucleotide
  Target: ATXN1; (+) strand; PAM type: YTN; PAM sequence: CTC
accacacccagactaaagtc

SEQ ID NO: 312274 - DNA, 20 bp, Artificial Sequence
  Description of Artificial Sequence: Synthetic oligonucleotide
  Target: ATXN1; (+) strand; PAM type: YTN; PAM sequence: CTA
aagtcactgggctctgtgcg

SEQ ID NO: 312275 - DNA, 20 bp, Artificial Sequence
  Description of Artificial Sequence: Synthetic oligonucleotide
  Target: ATXN1; (+) strand; PAM type: YTN; PAM sequence: CTG
ggctctgtgcgtgtcaccaa

SEQ ID NO: 312276 - DNA, 20 bp, Artificial Sequence
  Description of Artificial Sequence: Synthetic oligonucleotide
  Target: ATXN1; (+) strand; PAM type: YTN; PAM sequence: CTC
tgtgcgtgtcaccaagactc

SEQ ID NO: 312277 - DNA, 20 bp, Artificial Sequence
  Description of Artificial Sequence: Synthetic oligonucleotide
  Target: ATXN1; (+) strand; PAM type: YTN; PAM sequence: CTG
tgcgtgtcaccaagactctt

SEQ ID NO: 312278 - DNA, 20 bp, Artificial Sequence
  Description of Artificial Sequence: Synthetic oligonucleotide
  Target: ATXN1; (+) strand; PAM type: YTN; PAM sequence: CTC
ttaaaagacatacttctgaa

SEQ ID NO: 312279 - DNA, 20 bp, Artificial Sequence
  Description of Artificial Sequence: Synthetic oligonucleotide
  Target: ATXN1; (+) strand; PAM type: YTN; PAM sequence: CTT
aaaagacatacttctgaatc

SEQ ID NO: 312280 - DNA, 20 bp, Artificial Sequence
  Description of Artificial Sequence: Synthetic oligonucleotide
  Target: ATXN1; (+) strand; PAM type: YTN; PAM sequence: TTA
aaagacatacttctgaatca

SEQ ID NO: 312281 - DNA, 20 bp, Artificial Sequence
  Description of Artificial Sequence: Synthetic oligonucleotide
  Target: ATXN1; (+) strand; PAM type: YTN; PAM sequence: CTT
ctgaatcatctttcttgacc

SEQ ID NO: 312282 - DNA, 20 bp, Artificial Sequence
  Description of Artificial Sequence: Synthetic oligonucleotide
  Target: ATXN1; (+) strand; PAM type: YTN; PAM sequence: TTC
tgaatcatctttcttgaccc

SEQ ID NO: 312283 - DNA, 20 bp, Artificial Sequence
  Description of Artificial Sequence: Synthetic oligonucleotide
  Target: ATXN1; (+) strand; PAM type: YTN; PAM sequence: CTG
aatcatctttcttgaccctc

SEQ ID NO: 312284 - DNA, 20 bp, Artificial Sequence
  Description of Artificial Sequence: Synthetic oligonucleotide
  Target: ATXN1; (+) strand; PAM type: YTN; PAM sequence: CTT
tcttgaccctccaccaaact

SEQ ID NO: 312285 - DNA, 20 bp, Artificial Sequence
  Description of Artificial Sequence: Synthetic oligonucleotide
  Target: ATXN1; (+) strand; PAM type: YTN; PAM sequence: TTT
cttgaccctccaccaaactg

SEQ ID NO: 312286 - DNA, 20 bp, Artificial Sequence
  Description of Artificial Sequence: Synthetic oligonucleotide
  Target: ATXN1; (+) strand; PAM type: YTN; PAM sequence: TTC
ttgaccctccaccaaactgt

SEQ ID NO: 312287 - DNA, 20 bp, Artificial Sequence
  Description of Artificial Sequence: Synthetic oligonucleotide
  Target: ATXN1; (+) strand; PAM type: YTN; PAM sequence: CTT
gaccctccaccaaactgtag

SEQ ID NO: 312288 - DNA, 20 bp, Artificial Sequence
  Description of Artificial Sequence: Synthetic oligonucleotide
  Target: ATXN1; (+) strand; PAM type: YTN; PAM sequence: TTG
accctccaccaaactgtagc

SEQ ID NO: 312289 - DNA, 20 bp, Artificial Sequence
  Description of Artificial Sequence: Synthetic oligonucleotide
  Target: ATXN1; (+) strand; PAM type: YTN; PAM sequence: CTC
caccaaactgtagcaagaca

SEQ ID NO: 312290 - DNA, 20 bp, Artificial Sequence
  Description of Artificial Sequence: Synthetic oligonucleotide
  Target: ATXN1; (+) strand; PAM type: YTN; PAM sequence: CTG
tagcaagacaggcttcctgg

SEQ ID NO: 312291 - DNA, 20 bp, Artificial Sequence
  Description of Artificial Sequence: Synthetic oligonucleotide
  Target: ATXN1; (+) strand; PAM type: YTN; PAM sequence: CTT
cctgggaatgaaaatgacat

SEQ ID NO: 312292 - DNA, 20 bp, Artificial Sequence
  Description of Artificial Sequence: Synthetic oligonucleotide
  Target: ATXN1; (+) strand; PAM type: YTN; PAM sequence: TTC
ctgggaatgaaaatgacatt

SEQ ID NO: 312293 - DNA, 20 bp, Artificial Sequence
  Description of Artificial Sequence: Synthetic oligonucleotide
  Target: ATXN1; (+) strand; PAM type: YTN; PAM sequence: CTG
ggaatgaaaatgacattagc

SEQ ID NO: 312294-312323 - skipped (30 entries)

SEQ ID NO: 312324 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 312325 - RNA, 100 nt, Artificial Sequence
  chemically synthesized
  misc_feature (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 312326 - RNA, 96 nt, Artificial Sequence
  chemically synthesized
  misc_feature (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugc

SEQ ID NO: 312327 - RNA, 114 nt, Artificial Sequence
  chemically synthesized
  misc_feature (1)..(30): n is a, c, g, u, or other and this region may encompass 17-30 nucleotides;
  misc_feature (107)..(114): This region may encompass 1-8 urasil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 312328 - protein, 9 aa, Unknown
  Description of Unknown: Homing endonuclease sequence
LAGLIDADG
